United States Patent 7,745,391 (HUMAN THROMBOSPONDIN POLYPEPTIDE) - sequence listing, part 110

SEQ ID NO: 324864 - DNA, 1148 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcactgcagataattatgactatgactaatgagtgtacactgcacatcgaatactctgaacagca

SEQ ID NO: 324865 - DNA, 1827 bp, Homo sapiens
ccctccaacaccagcagcccctccgactgctactacggccctgaggacccccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324866 - DNA, 1647 bp, Homo sapiens
gtatctaaggatccggtgtttcgatgccacgggcacactgcagcgtgtagcaccaggcctgagcagaagatgagcttgccctcgcttggcttagacctgtacgccattcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324867 - DNA, 1580 bp, Homo sapiens
ggggaagggaagaaaaaactataggctaggtacgaggctgggtgtcgggagaggccgtgtagcgtcgccgttactccgaggagataccagtcggtagagggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324868 - DNA, 1452 bp, Homo sapiens
ctatgtcacaaggtcgtgacatggaataacacgtctcctgtccggaagtattcatggggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324869 - DNA, 1113 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagaggagtctgatgaggaagtggtgatgaaaaacaagaaatgtgttctagtctgggagggtacaggcaaagaccggagctttggagagatgaagtttaaacagtgttcttcagagaacatgggtcgtgagcattcaaaaagcatgggggtgaaccaattacgggaccttgggtgagtgatctgtgtaagagtccactgatggaaatactgaaggcctggctctcctccttggcttggccttcagtctct

SEQ ID NO: 324870 - DNA, 1279 bp, Homo sapiens
ccaggtagacctaacccaggtaacctaactgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324871 - DNA, 918 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacattttctcgtctgtggatgtggggccatggacattaatggtgaaaagggttccgaaaagtggttttaaaacaattttagagaagagggccgaatgggaaggg

SEQ ID NO: 324872 - DNA, 520 bp, Homo sapiens
aactcaggggcgagctgcaactcaggggcgagctgcaactcaggggcgagctgccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324873 - DNA, 981 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacggatgcggggagggctctccggtgaccttttctcgttcctgggttgggggc

SEQ ID NO: 324874 - DNA, 1018 bp, Homo sapiens
ggggaagggaagaaaaaactataggctaggtacgaggctgggtgtgccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324875 - DNA, 663 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaagtgtaccagtaagtgctgatgcagaagctacagcaagtcatcctaataatctagcctaccgaattaatgaaagtagctacgctggtcaggcatgtttgctcaacgcctgtaagttcagccttctgggacgcctgaggcgggtggatcacctgagttcatggagttcgaga

SEQ ID NO: 324876 - DNA, 971 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtataggttgcacagaaccggtggaaaaaccctataggggagtcacagaaaagagcagtgacaagaatatgacaggaacgcccagaaacaagatgtgacacgtagaccagcgagtcagaacaaaagaccacaacacacacactatgaggaccacacatggatgacaagcatcattgaacatgcttgacgatagagcagtcgtgaaacaaaaagaaaa

SEQ ID NO: 324877 - DNA, 530 bp, Homo sapiens
tggcttaaaaatcgtattattaatcaggttgactcgcatggcattactagctccatttgtcagataactcctaatatatgacgactaatcgacacatgtatcaccaatgaatacaaacaaaatagcacatgcatgactacctaatataggcgagtctaagagctactcgtcagaccttcagtatacagtaaccctgttcccaacgattgtactaggcctatcaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324878 - DNA, 442 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgaggtgcaaaaatgcagagtctgggtgtatttattttcctccccaccaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaaga

SEQ ID NO: 324879 - DNA, 3237 bp, Homo sapiens
  misc_feature (10)..(10): n is a, c, g, or t
  misc_feature (31)..(31): n is a, c, g, or t
  misc_feature (928)..(928): n is a, c, g, or t
  misc_feature (946)..(946): n is a, c, g, or t
cattcgctangagaggccggggttaatcggncgaggctctaaaggtggggaagctggagaataatagatgtgcaaaaataggcagtggaaataattctcagatgatgtgttccttgaaagcttgatgaaacagaaccacaaaaatggcacattttaatttttcctcataagttttgtttcaaggataacaagttttttgcctaggatactggagctaaagtatgccctttggaactttttttttttttttgagacggagtatcactcttgtggcccaggctggcgtgcagtggcatggtctcggctcactgcagcctccacctcccgggttcaggtgattctcctgcctcagcctcctgagtagctgggattacaggtgtctgtcaccacacccggctaatttttgtatttttggtagagacggggtttcactgttttggccaggctggtctcgagctcctgacctcaggagatccacccaccttggcctcccaaagtattggggttacagatgtgagccactgcacctggctggaacttttttgttttaattaggaaatttcaaacatatagaagtagacagaataataatgaacctgcacatatgcattgcatagcttcagtaattatcaagttgtggttaattttgttttatctgtaccctttccctattttgtccccccatgatcaagagatgggtatctcaccatgttgccttggctagacttgaattcctgagcttaagcaattctctgtcctcagcctcctgagtagctgggacaaaggcaacgcaccacggtgcctggtttatttgtatctttaaaaaactattttaaattgaattaaccaggcatggtatacgtctgtagtctaactactcaactaggctaagctgatagggctgattgagcctaggagtttgaggttncagtgagctatgctcatngcactgcacttcagcctgggtgatagagtgagacccagtctcttaaaaaaaaactaatgatggtaaaacatacataacataaaatttactatcttaaccgtttgtaagtgtagacattattttaaaatctggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324880 - DNA, 1481 bp, Homo sapiens
ctgctcccagtcagtcccgaaaatagtcattcaagtggtaaaataagacaaggcagaggacgatgtctctaacttccctgatgggagaagactgccatcaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattctggactgggtacagactgtgctatgcggacggtgctactgggcactaaacacacacgagtgtgccagtgccccatctgctcgctgtgcacaagctggtaccaccatgctcactccatggagcctgacaactagtgatgaccggatgcgaactcttgcggatttgacccacaccaagcaacttgacacgctatatgggtcagtgctgctaccaactgcgaagcgaatctcgcgtgcacatctgcgtggcaacctacactcctgacatatcagacctgtgcacgctccatggacgactgcaactttgaccctcaaaccaaagcgtcagccgactatctaactaacgcttgcacgctgtcactagccttctcgtcaacaagcgcgtcaacaacgaaggagcacttatactgcgactagcccagcaattcataccctgcgaaacacagcggtcagccgcataccacttcgcaatagcttagatactaccctgacctgctactaactctaggggagtatgcttgcgaggacagcagcgtgccacgtgcagtcgtctggcacttagaccaacgctacaattcatggtgtgggaatcataggcataactcagactactgatgaatggtcaatcccctgaaagtctctaacttgttgactgtctgaagaacactgcgacaaaacccactgtcacatcgtctaatcagccatacacgccgcgatacacctgcacacataccgcgataatatttaaataacatgggagcaacacctgtatcaaagtatgcgatgtccaacaagccacggggtaaaaagagagatataaatcacaaccatacaccaagacgtagaacatgtacagaacgaataaacccatcgaacaatataagaaaactattcatacccaccgctgcaaccgcacaccacacaaatcagcttaatacacactatcaccctaaactcacccaccatcagcaccacaatacccgatcatatcatatctacccgacacaacacactaaatatacatcccactcacacaaacgactaaaacacatacaaacatataactctccactacactcaccatatcatcatcacaccacaaccaatatccaacagccccaaacaaactcacaatacgacaatcattcatgctatacga

SEQ ID NO: 324881 - DNA, 2671 bp, Homo sapiens
ggaaaccttcctcagtatgtgtccaacgaactgctggaagaacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324882 - DNA, 3204 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttagtgtgtggtccttgatggattgtggtagaatgcactgctgtcttggactgtcttgagtattttttgtttttcagagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324883 - DNA, 3048 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactgccatgctacctcgtgtatttataaatgtgttggcaaatatttcctggctgcttctcaggttctttctttggattggagatgttttagctgcccatggtcctagaagttacctgctaaaaagaaagcagctgaatgctggtctcatgaggtttctttgggggttgcctcagggctgggcacacttaacagtgagtttcctggtgaactgatagttttcagtaggccagtctccttggttgagtctcctgttaatctgctcaagttctgaaatgcctctgtcttaaatacattggtgactctctgtaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324884 - DNA, 2609 bp, Homo sapiens
  misc_feature (10)..(10): n is a, c, g, or t
  misc_feature (31)..(31): n is a, c, g, or t
cattcgctangagaggccggggttaatcggncgaggccgggagaggccgtgtagcgtcgccgttactccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324885 - DNA, 2685 bp, Homo sapiens
aaaatgatgtattaggtgcgggcgtcgggtgtagatttcagtcgacgcggggcagaggctgtgattgtatagtcgtgtgactcctggggcagtatatcagataggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324886 - DNA, 2608 bp, Homo sapiens
  misc_feature (10)..(11): n is a, c, g, or t
  misc_feature (18)..(18): n is a, c, g, or t
atcgctaggnncgaggcnggggttgaatcggccgagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324887 - DNA, 2619 bp, Homo sapiens
  misc_feature (7)..(7): n is a, c, g, or t
  misc_feature (21)..(21): n is a, c, g, or t
  misc_feature (26)..(26): n is a, c, g, or t
  misc_feature (28)..(28): n is a, c, g, or t
  misc_feature (65)..(65): n is a, c, g, or t
  misc_feature (70)..(70): n is a, c, g, or t
aacgaangatgtatgaggcgntcccngngtgtaatttcagtcacggggacgaggccgtgtatctngtcgncgttgctccgaggagataccagtcggtagaggggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324888 - DNA, 2464 bp, Homo sapiens
  misc_feature (27)..(27): n is a, c, g, or t
ggctgtttctagagtatccctccgatnacagcaatagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324889 - DNA, 1653 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaacggagttctggatgaattgcccaaaaagtgcgatactatagtgcggtcattttcaacctaaaaggactttggtacgattccgaaaggagggcccaataaacgcgaaacgatcgagacaagggc

SEQ ID NO: 324890 - DNA, 1619 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgctgtgaaaaattggacccttagaaaagtcagaatccattaatttaagcactttcttagacacacttcaagggcttcaaatgtatttcatttacctcatctccactgatttgacagctaattctaatcagtgagttttcttctaatagttactgtcctcatgtgttaccatat

SEQ ID NO: 324891 - DNA, 2576 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324892 - DNA, 2490 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324893 - DNA, 1241 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaatgtgggacagcatatcgaccatcaacacgaactcgagctcgagacagacgccgggccccgtaagtagtagtagcggcag

SEQ ID NO: 324894 - DNA, 2518 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324895 - DNA, 1889 bp, Homo sapiens
ggggaagggaagaaaaaactataggctaggtacgaggctgggtgtcgggagaggccgtgtagcgtcgccgttactccgaggagataccagtcggtagaggagaagtcgaggttagagggaactgggaggcactttgctgtctgcaatcgaagttgagaggcccagtatttaggcgacagtgaatttattactctgaagagggttctgcacatatttccaaattatattggtggtcatcagaagtaggtgataggaagaaatacttctcaagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggta

SEQ ID NO: 324896 - DNA, 2374 bp, Homo sapiens
ggtctttgcgcggctcgtaggtggctcttcgtgctggcagcggtgcacatggcctgtctgcactgtaaccacaggctgggatgtagccaggacttggtctccttggaagacaggtctgatgtttggccaatccagtccttcagaccctgtctgaaacttgtatcttacgtgaacttaaagaataaaatgcatttctaccccacgcgccggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttagtgtgtggtccttgatggattgtggtagaatgcactgctgtcttggactgtcttgagtattttttgtttttcagagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggtttttttttttttggtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaa

SEQ ID NO: 324897 - DNA, 1128 bp, Homo sapiens
gggagaagaaattatccaagatacttgacagaacaaagatattgtcaacataactgtaaatcaaaaggttgcgttttataaagggaatgtagatgggtaaatttttgggaaaagctcatcacattcttaccaagaaatttcagtaaattgtgtaggaatataatttcagtagtagataagatgctatatctaattaaatagttgtccatcttgaggtctgacacttcacagacctttaaaaaagataaagaagtactttttatggatttgttaagcaaaaaattacagaacagctcaggcaacatgacgaaaccccacctctaccaaaaaatacaaaaaattaggtgggtgtggtggcgggcacctgtggtcccagctactcgggaggctgaggtgggaggatcacttgagcccagaagacagaggttaaagtgagccgagatcactccactgaactccagcctaggagacagagaccccaactccaaaaaaaaaaaaaaagaaaaaaagaaaaatacctaggtggtattaaaaaatgtatacacacacacacacacacacacttaattactaccataaccacacatcaacacacatacaaaatgactgttcacatcctttattagtttcctaatgccttaaaattaccttaaacaaattaccataaacttagtggcttaaaacaacagaaatgtattatcttacagttctggaggtcagaaattcaaaatgggtcttagcgggctaaaatagagatgtcggcatggctgcattcctaaagagtctgttttcttgcctttttcagcttctagagctcatgaactattctttggctcatggcctccttccaccttcagagtcagcaatggctttctcacatctcatcattgacacggattcttctgcttcccctttacacacttaaaggaccatgtaattaggcctcctcaggtgatccagaataatctattttcagatcatctgagtagcaaccctaatttttatctgcaacttgaattatctctcaccgtgtaacataacatattcacaaatcccagagagattaggacatgtacatctttggacatctttggtaggccattattctgcctaccatatgtatgaata

SEQ ID NO: 324898 - DNA, 780 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagtcatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324899 - DNA, 332 bp, Homo sapiens
  misc_feature (123)..(123): n is a, c, g, or t
gagttagttgtagtccggcttgcggtggggctgactcgtgctctccacgctcaggcgtggaagccaaggctgtgccaggcctggccaggccaagcaggatgacagcaaacgcattctgaacgngtagcaatcaggtcccctgtaatgttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324900 - DNA, 1627 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324901 - DNA, 1899 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtaaaaaaaaaacacaccacaccacaacaacaacaacaccacaccaacaccacaacaacaaggcgcaaccgctctaccaccccccacccgcccggaccccatcctgcgcctccccaccctctcgcgcaacgggcaccccaacatgagcgccccacattcgcagcacagccccacatctacacaccccctccctcggacacctcgcctggctcacatggcgccccccacccggcctcaatctcgccacctccccaccttgccctcggcatcaccagtaccacgaccaccttccgtgcccacccagcccgctcgc

SEQ ID NO: 324902 - DNA, 1909 bp, Homo sapiens
  misc_feature (1619)..(1619): n is a, c, g, or t
  misc_feature (1690)..(1691): n is a, c, g, or t
  misc_feature (1835)..(1835): n is a, c, g, or t
  misc_feature (1885)..(1885): n is a, c, g, or t
  misc_feature (1887)..(1887): n is a, c, g, or t
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtaaaaaaaaaaaaaaattacaaaaagataatnctttctcacctaatactttctggctcaaacaatccaccctatagtgggcttctaaaaattcactgggcgtnnctttacaacggaaggagtgaaaaagccgtgggcgcacccaaataaatttgtttacacactttcctctttccgcggggggtcttttaaaagaggggccccctctggccctcctccaaacttgtgccccatttggacggggagggnaattggggcgctttttattttagtaaccccgcaattaaatttttaaatancnaattatttttgtaaccaccggg

SEQ ID NO: 324903 - DNA, 1382 bp, Homo sapiens
ttgctggcttttccttgctgctgtccttcctgcttagacgcctggtgactctcatttcgcagcaggccacgctgctggcctccaatgaagcctttaaaaagcaggcggagagtgctagtgaggcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324904 - DNA, 1873 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324905 - DNA, 1206 bp, Homo sapiens
tcggtctcccattactttgtcacggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324906 - DNA, 1274 bp, Homo sapiens
ggccttttttccaatagtcttgaatggatgtcaaattagagaattgcaagccactgaggctgactttgcatgggctattcggccattggagaagagtacaaagctggatttccattttgctcagggccctagagctcgtgtgtgtgctttctcttcaactcctgtcctttttgtcttcttcacagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324907 - DNA, 1170 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagttgttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324908 - DNA, 1026 bp, Homo sapiens
gagtcgtcaggccgttagtccgtgatcagtccgtcgaccgtgcgcgcgtctgccgcggaggtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324909 - DNA, 1609 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaagtcatttacatcatttcaagaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324910 - DNA, 772 bp, Homo sapiens
actctagaggatccccttcatatggcaaggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324911 - DNA, 1399 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324912 - DNA, 1452 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagttgcatatcgcaaggccaagggggaacacagtgtttagtttccagctcactttgtacccctcacctctgcagacacggggagaaccccggacccctggcatgcatgctggcggcggcatgcctcccttccacaagcccatgctgctgcatagggagcctgtgtttgcaaaacccagtggactgcgctgggtctgctgtctgagcagctcctggctccggtgggaactgcacacaattc

SEQ ID NO: 324913 - DNA, 697 bp, Homo sapiens
ccgcttgcttcacggcggcgatgtttgcatctctctgacttggaaaacgccaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324914 - DNA, 1220 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcagcttcagtaaatagttgtatctcccagaatgagtagtgggggcatccctgttatcctcacctactgcaagaggggccgtgtgtgagactgccgcgtcctgatgatggcctc

SEQ ID NO: 324915 - DNA, 528 bp, Homo sapiens
  misc_feature (24)..(24): n is a, c, g, or t
  misc_feature (38)..(38): n is a, c, g, or t
cgagcccggtaccccgcccgcaangctggaggagcacncaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324916 - DNA, 559 bp, Homo sapiens
  misc_feature (60)..(60): n is a, c, g, or t
ttgacagcgcgcatccgaactcgactgcgtactcaaggacatagttggaccgtgagctgnaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324917 - DNA, 1388 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324918 - DNA, 840 bp, Homo sapiens
cggacgcgtgggtcgacccacgcgtcggtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324919 - DNA, 492 bp, Homo sapiens
agacatagaagaagtgcaggttgttacataggtatacatgtgccaggtgatttgctgcacctatcaacctgtcatctaggttttaagcccctcatacattaggtgtttgttctaatgcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324920 - DNA, 2188 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtaaaaaaaaaaaaaaaaaaaaaaaaaaaaaaaaaaaaaaaaaaaaaaaaaaaaaaaaaaaaaaaaaacaagaacagcaagacaaaaacaacagagggggggcggcgacaaagagataaaatcaaccggggggggagcgaacactaagtgcagacgaccaccgcacgtacttgtgagaagacaaggggcccacccctagtggacgggcgcgctatacaagtacgacgtacgcagcgcgaggcgagtacacagcccacgggcggcgagcgggaccacagccagccccgcgcccgggggcatcttcccgggcgaaaacagcgaacaccacacccgcggggaggggcagcgaccatgggaggggaaagcagacaccgagagcggcaggatccgacgccacgcccgggagcgcaaagaacaaaagccgcgccgcgccgaagtcggcgggggttcacccccacgcgccgctgccgcgggcgcgacatgcagagacctccgcggccgcagggactaacaagagggcaacaggcc

SEQ ID NO: 324921 - DNA, 923 bp, Homo sapiens
  misc_feature (11)..(13): n is a, c, g, or t
tggggggaacnnnaaaaaaaacattagctagtcgaggcctgggttagctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattggagtttctcttgagggcaataaaagttgtcatggtgtgta

SEQ ID NO: 324922 - DNA, 660 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgaaacaagctcacatcttcctgtgggaaaccttctagcaacaggatgagtctgcagtggactgcagttgccacttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324923 - DNA, 248 bp, Homo sapiens
ctccattaaagggactgggggatggcctctgtgtttcttttgctttatcttgagcttttttgtcagccctttccctctactttgggggcctgcaaaagcagaggggctttattttgagaagtagcctcctgtataacctcgtttgagatagatttgggccagtttctggtgtctgtagcagtcgggttttttccccctaattcctgtcttttcgtttctgttttcttggtcatttacatcatttcaag

SEQ ID NO: 324924 - DNA, 381 bp, Homo sapiens
cctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtaacgtggtgcggtgtgtg

SEQ ID NO: 324925 - DNA, 507 bp, Homo sapiens
tggaagccagctgcaggcaggcgaggaaggaggcccttactcttccttcttgtccatgggaccatctactgcagcctgcagctttgcgtgctcctccagcaagcggtcgtactccttggtgaggccctcagacccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324926 - DNA, 1589 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324927 - DNA, 1534 bp, Homo sapiens
  misc_feature (232)..(232): n is a, c, g, or t
agtgtggacaagggccgagatgacgagctatgagctgtggaagggaatgggggaagcagaagggcacaaacagaagtactggaggaagagaacaggagcctgaaggctgacctgcagaagctataggacgagctggccagcactaagcaaaaactagagaaagctgaaaaccaggttctggccatgcggaagcagtctgagggcctcaccaaggagtacgaccgcttgctgnaggagcacgcaaagctgcaggctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324928 - DNA, 1429 bp, Homo sapiens
  misc_feature (123)..(123): n is a, c, g, or t
gagttagttgtagtccggcttgcggtggggctgactcgtgctctccacgctcaggcgtggaagccaaggctgtgccaggcctggccaggccaagcaggatgacagcaaacgcattctgaacgngtagcaatcaggtcccctgtaatggctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324929 - DNA, 1847 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtattgtatgtgttttgtatttctctggagtgcaatggtgcaatctcagctcactgcaacctctgcctcccaggttcaaaccattctcttgcctcagcctcctgagcagctgggattacaggcgctggccacacacccagctgattgttgtatttttagtagagctgggtttcaccatgttggccaggctggtctcgaactcctgacctcaggcaatccacccacctcagcctcccaacatgctgcaattacagatgtgag

SEQ ID NO: 324930 - DNA, 2320 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324931 - DNA, 1715 bp, Homo sapiens
  misc_feature (1591)..(1591): n is a, c, g, or t
  misc_feature (1594)..(1594): n is a, c, g, or t
  misc_feature (1596)..(1596): n is a, c, g, or t
  misc_feature (1601)..(1601): n is a, c, g, or t
  misc_feature (1625)..(1625): n is a, c, g, or t
  misc_feature (1628)..(1628): n is a, c, g, or t
  misc_feature (1632)..(1632): n is a, c, g, or t
  misc_feature (1637)..(1637): n is a, c, g, or t
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtacnacnanaccanggggcggctaaaatcccggggccngtnccgncccgnttttgaacgggccctagggcgcttaaagggggccgtaacacgtgggaagccggctgggcccccgggatgggcccaatg

SEQ ID NO: 324932 - DNA, 2114 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgtaaaaaaaaaaaaaaaaaaaaaaaaaaaaaaaaaaaaaaaaaaaaaaaaaaaaaaaaaaaaaaaaaacaagaacagcaagacaaaaacaacagagggggggcggcgacaaagagataaaatcaaccggggggggagcgaacactaagtgcagacgaccaccgcacgtacttgtgagaagacaaggggcccacccctagtggacgggcgcgctatacaagtacgacgtacgcagcgcgaggcgagtacacagcccacgggcggcgagcgggaccacagccagccccgcgcccgggggcatcttcccgggcgaaaacagcgaacaccacacccgcggggaggggcagcgaccatgggaggggaaagcagacaccgagagcggcaggatccgacgccacgcccgggagcgcaaagaacaaaagccgcgccgcgccgaagtcggcgggggttcacccccacgcgccgctgccgcgggcgcgacatgcagagacctccgcggccgcagggactaacaagagggcaacaggcc

SEQ ID NO: 324933 - DNA, 1274 bp, Homo sapiens
tgtgtagctgattctgtgttcccgttcggcatacttggaagcacgccgcgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324934 - DNA, 1341 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324935 - DNA, 1050 bp, Homo sapiens
gcacaaggatgacaatgagaaccacaaagaaggtgttgccatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324936 - DNA, 1435 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacaccccaagggttttccagtcaagaaccgctagatctacggcttttatcacaggataagcttatgacatgatacggattcactcgccgcactc

SEQ ID NO: 324937 - DNA, 1001 bp, Homo sapiens
gtgcccgatcgcagcaactattccggcagctatcattgcttttgacgataaatcgtgtccctccagtacaatcatagagatatgtagctgcactaccttacgcatttccagatccccgatcgcatctctactgtccgtcgctttacattgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324938 - DNA, 950 bp, Homo sapiens
ggcaggtccaggctggagctaggtgtggagtgggagcaaccaggaggtgctcctgccagcccttcatgctctttttctcacttctcccttctttttgtaaataattgcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324939 - DNA, 1448 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggacccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324940 - DNA, 1070 bp, Homo sapiens
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaattagaaaaatagagaagctgaaaccggtttggctggggaaaagtggggctacagggtcga

SEQ ID NO: 324941 - DNA, 1610 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324942 - DNA, 1495 bp, Homo sapiens
  misc_feature (27)..(27): n is a, c, g, or t
  misc_feature (31)..(31): n is a, c, g, or t
aaagttaggctaggtacgaggcctggntgtngtaatcggccgaggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttcggttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgtgagaggcaggggcgaggggaaaccgggcggcgcctctagaagctggtctcgggggcggggcggggggcggtgaagccccacctggaggagcggccgggatgggcctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattggagtttctcttgagggcaataaaagttgtcatggtgtgta

SEQ ID NO: 324943 - DNA, 498 bp, Homo sapiens
ggcgggggtggctctgcaatggccacggcctcgaggcttctcacccccccttgtgcccttctcttggctcttgactgtgaactgctcctcggccggttcatcaggtggactctctaaatggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacattccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 324944 - DNA, 6456 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324945 - DNA, 6350 bp, Homo sapiens
atattctgtgaacatttggaattctgtattcaaaatctattttgaccattcccaagtgattttgaaggtctttggcatgtcataatttgttattttgtcaaggccagtgtttgggtgtgagagtggtgcacagggcaggagtgtgtaactttgttaggaagtgagcctagccacaccctcctgagtcactggttctttactatcctggggtaggcaatatcttttgttcagctgataaaagctttgtcattgtgaagattggctcccaatgataggaaactgctggtgatgaaaataaaggggtcttaaagattattctcagccagaaaaaataagtgttagacaaattaaatggaaaataattaatattttagtagtctttacaatttggaggtctaaggctctgtcagcatgggttctttaaggtcaaggatctaggatacacatgcacaggaaaaaagactggaagtatgctaagcagtgactatctctgaatgattgtgaaaaaattttaggatgaataagcagaaaaaaacaataaatgacaaaatataacaatggagttttcttgacaatgaaattctcttaaacttaaatctctttaattaggcaggtaaactattttatcatcttcgtttgacctggcccttcttttcaatgttaacagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324946 - DNA, 6309 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324947 - DNA, 5550 bp, Homo sapiens
cccctcgcgaacgtgttatccgaacggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324948 - DNA, 5841 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgaaagcggaagtataaagcgttgagctcaacgctttatacttctaaataatataatcatagaaattaccctgtagtcaatgtctatttatttattcattttgagacaaagtctcactctgttgcccagactggagtgcaatggcacgatctcggctcactgcaacctccgcctcccaagttcaagcgaatctcctgcctcagcctcccgagtagctgggattacaggcactgcgccaccacgcctggctaacttttagtatttttagtacgagacggggtttcaccatgttggccaggctggtctcgaactcctgacctcaggtgatccacctgccttggcctccaaaagtgctgggattacaggcgtgagccactgcgcctggccagttgacatttaatgagggatagctactgaggaccagggacactagcaaagttctggaagcagagtcccagctttctggggcatgtacagatgcctggtgttctgtgtctttcagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324949 - DNA, 4518 bp, Homo sapiens
tgaagacaggagttgcagtgagctgcagccggtggtgactgtgttttgttcttcagcatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324950 - DNA, 3102 bp, Homo sapiens
tatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324951 - DNA, 6393 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcgagatcgggaacaaataaacacggggggggggttcccccccctctactccattcactcttactctctattccctactctctcactttcacaccctaacctcccacctatgttggtgttaggggtggtgtggagat

SEQ ID NO: 324952 - DNA, 6194 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324953 - DNA, 1409 bp, Homo sapiens
  misc_feature (6)..(6): n is a, c, g, or t
cgaatngtaaccgttcgtacgagaatcgctgtcctctccttgctcgagatccattgtgctctaaagctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324954 - DNA, 1453 bp, Homo sapiens
  misc_feature (6)..(6): n is a, c, g, or t
cgaatngtaaccgttcgtacgagaatcgctgtcctctccttgcggccgccagtgtggtggaattcccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324955 - DNA, 5128 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatacctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324956 - DNA, 1072 bp, Homo sapiens
gatgctcgggttgcgtactctagagatctcggcaacagaggactactatacactaagagcgagtacggaatgacaccgtgagatcatcactcatccagcggctggtcatgcaaggtattggacgggcccgtgcccgtacagctgtacgtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324957 - DNA, 4139 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324958 - DNA, 1463 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacgttcgcgagggtaccggctcgattcta

SEQ ID NO: 324959 - DNA, 1571 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgaaagcggaagtataaagcgttgagctcaacgctttatacttctccatgcatactttgaatatgtgcttctactgggtagaatgtggagatagcgaataatgtgggtataaaattcagactgggataaatggcaataggtattataacggaagttgatagactgcatg

SEQ ID NO: 324960 - DNA, 377 bp, Homo sapiens
tatgatgagcttgttcctgcttctttgactacgaagtatggaggattttacattaactcgggaaccctgcagtttagacaagcatcagagtctgaagatgacttcattaaagaaaagaagaaaaaatctccaaaggttagaatgtgcttgcttttggatttcagaaatgctttttgacgtgaccctatcagatcagtaggtgacttgccagaatacgtggcgcttggccggctcaggaggatggtggaaaggcagagccgtgccaggttgatggctcgcctcttacacgtgtgccctaatgaggacacgtgcccgtgggggctctgttcagcacttggtcattatgtccatgtcacatgacatcccagcaggctcag

SEQ ID NO: 324961 - DNA, 372 bp, Homo sapiens
tcacatctcgggacaagtgttgtttttggtctcctctggatattctctaaacttttctgtgctcattcctttgaacagggccaagaagaaagttatggccccttctaaaatcaaggtgaaggtgagtcagtttgctcgggtcacatgtcagctatgcccatctccctacaactatgctctggaaacagtcaagtgactgtggaagctcattgatctttgctcgtctggggacagctgctcaggatgacattcttgaagtcataacaggacagagacccaagccacttaacccccctctagccttggttctacaaacagtacccagctggcccagttcctggggttcatgtgggattaagtgggatcttcttg

SEQ ID NO: 324962 - DNA, 359 bp, Homo sapiens
ggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccaggtgagggccgtgtgctgagatgggcatctgtgcagtcaagacacgtttgaacgctgcttttgtgccaggccaacaggatccttgctcacagggagtcactgtctagctgcctcaactctgatctcacctgagtaactgggggacatgcaggtagctgggaaagggtcttctggatcttccctggaggaagggaagttgcctccagggttttg

SEQ ID NO: 324963 - DNA, 210 bp, Homo sapiens
agggtggagttggaaaggtggcggtgtgactgtattgacaggtgctctttatggagcgatgactcctgtgcctgtgggtgagcgtaagggacatgtggggaaagtgcactaacggctgttactgtctgctgtgcaccaggctgccagagctgctgagggggagagcagacagaagttcttcacccaggatattaatggaatcctattaga

SEQ ID NO: 324964 - DNA, 477 bp, Homo sapiens
gctttcctgttcctgtcttcaatgtgtgtgttttgttcttttctcccctcctgttttctctcaggtcttctggctggcttgcactccagcccgccccatgcagcgcctctcccacacgctgcggtgcccacccatatcccgcagagtctgccaggtaatcacccgacggtcagtgtgccacgcgcaccgtgtgcctttgccctctccacccctaggtgctttgccgctgccaagggtcttggtgtctttgccttgacgctgttgttgttttggtttgtcctttgaggctgtgctttgtcagtactcagggtgacacgcacttctactcttggggtttcctctggtccccacttggactgccgccaggtcagcctcagcctgtgtgatcacagggaaagttgcggggggcagggtggtgcgcttttgtgtgcggtggaggagttcctaaccctcggcttgtttttttctcttcagttt

SEQ ID NO: 324965 - DNA, 557 bp, Homo sapiens
cccctcgcgaacgtgttatccgaacggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacgttcgcgagggtaccggctcgattcta

SEQ ID NO: 324966 - DNA, 4976 bp, Homo sapiens
  misc_feature (132)..(132): n is a, c, g, or t
  misc_feature (164)..(164): n is a, c, g, or t
tatatatccaagaggtaataaaaccctggcccaagcttagcttagatgatggtttaaggagcacagctttcctgatagttctgacctcaatgaccaagtgaataggttttaagtaaacggaataaaacagcnaaattagctagagccaaagagaaggtttccanggcccagagccagttatctagaaggaaagacgtgactgcaaggtgactacagaatggcctgtagcccagagggatgggttggcacaagctaaagaggtatcttcttcgaagtataaagcgttgagctcaacgctttatacttcgtagtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagtataaagcgttgagctcaacgctttatacttctaaataatataatcatagaaattaccctgtagtcaatgtctatttatttattcattttgagacaaagtctcactctgttgcccagactggagtgcaatggcacgatctcggctcactgcaacctccgcctcccaagttcaagcgaatctcctgcctcagcctcccgagtagctgggattacaggcactgcgccaccacgcctggctaacttttagtatttttagtacgagacggggtttcaccatgttggccaggctggtctcgaactcctgacctcaggtgatccacctgccttggcctccaaaagtgctgggattacaggcgtgagccactgcgcctggccagttgacatttaatgagggatagctactgaggaccagggacactagcaaagttctggaagcagagtcccagctttctggggcatgtacagatgcctggtgttctgtgtctttcagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgactcctttttttacataagaaccaatctgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccatgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacaaaaaaaaa

SEQ ID NO: 324967 - DNA, 4501 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcaaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtcttctggctggcttgcactccagcccgccccatgcagcgcctctcccacacgctgcggtgcccacccatatcccgcagagtctgccaggtaatcacccgacggtcagtgtgccacgcgcaccgtgtgcctttgccctctccacccctaggtgctttgccgctgccaagggtcttggtgtctttgccttgacgctgttgttgttttggtttgtcctttgaggctgtgctttgtcagtactcagggtgacacgcacttctactcttggggtttcctctggtccccacttggactgccgccaggtcagcctcagcctgtgtgatcacagggaaagttgcggggggcagggtggtgcgcttttgtgtgcggtggaggagttcctaaccctcggcttgtttttttctcttcagtttaaaaaaaaaa

SEQ ID NO: 324968 - DNA, 4688 bp, Homo sapiens
cgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagcagccgaccgctagctgcgccgccgcccggggaccggcatgaggaccgccgcggggggacgtctgcggcccgcgtcggcgctggggacaaagaagccatgcagtgacacccgctaagacttgttggtagccatgtcggagccccacagggtccagttcacctctctcccaggttccctgaatcctgcgtttttgaagaagtcccggaaggaggaggctggggcaggagaacagcatcaggactgtgagccggctgcagcagctgttcggattacactcaccctctttgaaccagatcacaaacgctgcccagagttcttctacccagagctggtgaagaatatccgagggaaggtaaaaggccttcagcctggagataagaagaaagatctgtcagatcctttcaatgacgaagaaaaggaaaggcataaagtagaggcccttgcccgaaaatttgaagaaaaatacggtggaaagaaacgtagaaaagaccgaatacaggacttgatcgatatggggtatggttatgatgaatccgactccttcatcgataactctgaggcgtatgatgagcttgttcctgcttctttgactacgaagtatggaggattttacattaactcgggaaccctgcagtttagacaagcatcagagtctgaagatgacttcattaaagaaaagaagaaaaaatctccaaagaagcggaagttgaaggaaggtggtgagaagataaagaagaagaaaaaaggatgacacttatgacaaggagaagaaatcgaaaaagtccaagttttccaaagccggcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagttcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggctgccagagctgctgagggggagagcagacagaagttcttcacccaggatattaatggaatcctattagacatagaggcgcagactcgggagctgagcagtcaggtccgctctggggtgtatgcctatcttgcgtcattcctgccctgcagcaaggatgccctgctcaagcgtgctcggaaacttcacctctatgaacaggggggccgtctgaaggagcctctccagaagctcaaggaagccattggcagggcgatgccagagcagatggccaagtaccaggacgaatgccaggcacacacgcaggcaaaggttgccaagatgctggaagaggagaaagacaaggagcagagggaccggatttgttcggatgaggaagaagatgaagaaaaagggggcaggaggataatgggacctcggaagaagttccaatggaatgatgagatcagggagctactgtgccaggtggtgaagatcaaactggagagccaggacctggagaggaacaacaaagcccaggcttgggaggactgtgtgaagggctttctggatgcggaagtcaagcccctctggcccaaaggctggatgcaggccagaactctgtttaaggagagcagacgaggccatgggcacctgacttcaatcctggccaagaagaaagttatggccccttctaaaatcaaggtgaaggaatcgtctacgaagcctgataaaaaggtttctgtcccatcaggacagattggtggccccattgctttgccctcagatcaccaaacaggaggcctgagtattggggcctcgagcagggagctcccatcccaggcatcgggcggccttgctaaccctcctcctgtcaacctggaggactcattggatgaagacttgatccgcaatccagcctcctcggtggaagccgtgtccaaggaattggctgcattgaatagcagagcagctgggaactctgaattcacactgcctgcaccctcaaaagcacctgcagaaaaagttggaggcgttttatgtacagaagaaaaaaggaactttgcgaagcctagtccttctgctccaccaccagctagctctctgcagtcacccctcaattttctggcagaacaggctctggcactggggcagtcctctcaggagaaaaaaccagagagttctggctacaaagagctgtcctgccaggctcccctcaataagggcctgccagaagtacatcagtccaaagctaagcaccacagcttgccacggacgtctcacgggccccaagtggcagttcctgtgcctggcccccaggtcaaagtctttcatgccggcactcagcagcagaaaaacttcacgcccccatctccatttgccaataagctccaaggcccaaaggcttctcccacacagtgtcatcgttccctcctgcagttagtgaagacagcggccaaaggccagggcttccatccctctgcaccagccacctcaggaggcctgtcagcctccagcagcagctctcacaagaccccagcctcgtcctcttctgccctgagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcagtgagtatctgtcatagcagcctgccctgccccactcacaggggccttggggatgaggattgcttggccttgccccgggtggagagtgagatctaaaaccacaggtcaggtaggaacagtgggctcagacgtaggaagggagactgggctccctgttctcaggtattcacttttctggtgacaggaagcccaggatggcctaaagcttcttctgaggagggcagagggacctaaaggatggccagcaccaagcaccatgcctcttcggaggctgtctgtgtggcacagaatgagcaacagcccttgccttccgtgaccccttgcctctccatctctctaaagggggctggaaatgctgtcttctatcagttgagtcatgtggaggtgttcatggaccaggaatagcaggaccttctaagagtgattctgttggtttttgaaggacagagtccaataattaatgcatctcgcttgtgtgtaatcacagcaggttcgggaagagggagtgagcattttcttttctttttttcttttttttttttttgagacgaagtcttgctctttcaccaaggctggagtgcagtggcgctatctcggctcagcgcaagctccacctcccgggttcacgccattctcctgcctcagcttcttgagtagctgggactacaggcgtccgccaccacgcccagctaattttttgtgtttttagtagagatggagtttcaccatgttagccaggatagtctcgatctcctgacctcgtgatctgcccgcctcggcctcccaaagtgctgggattgcaggtgtgagccactgcacccggcctctttttctaatatataaatgaagtg

SEQ ID NO: 324969 - DNA, 345 bp, Homo sapiens
tttcatctgtaagtagttcactaggtagctctaaaagactctaaggactttttcttaaacataaccacaaataccatcatcacccaaaaaattagcaataattccctaatagcatcccatgtctagtcagtgtccagatttccttgattgtctcatggaagtgctgtttgtttgtttgtttgtttattttgccagttggctggtttgaatcaggatccacatactgcctacatatgcatttattgatttgtctatgtttcttttagtctgtaggttaccctttcttttactgcctttcagtttgctgttgttggtattgaagacatcagtccttttcaaaaaaaa

SEQ ID NO: 324970 - DNA, 9158 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324971 - DNA, 9142 bp, Homo sapiens
tgagaagctatttctgtccacactctgtgatgtctacaccttcagaatggggaatgggtttcaggggtctctgacagatagagctcatgcaatgatttctggtccggtgctgatcagccttcaaaggatgttatttggttacgctccataaaacttgagccagcccactgttccttgtcacaacccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324972 - DNA, 8446 bp, Homo sapiens
aaagtcaggctggtacggtctggagagttaggagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324973 - DNA, 9105 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324974 - DNA, 9188 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggaaaaaaaaaaaaggggcggcggcaaaatac

SEQ ID NO: 324975 - DNA, 9104 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgtggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324976 - DNA, 9556 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacagggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324977 - DNA, 9389 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcaggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324978 - DNA, 9390 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacagggcacagatgaatccttcatatttatctggatttagctggtagcatttgtctcctaagacttggtcacagaggaatccatgtgaccttcaggccttctgctctaaactggcaggagatcctgtttctactcacagcgtccgagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324979 - DNA, 9436 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacagggaaaaaccagctctcacacctgctcctctgtaaagcgtcttccccaagcccacacgtaatttggtggctgtccttgaaagtatttcccaagatctccaaaccgctttaaacttccaaggtctgagcctgacctggcctcgctaacaaagggttccactgatgccgactctaagaagaaagttttcaagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324980 - DNA, 8718 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324981 - DNA, 7243 bp, Homo sapiens
  misc_feature (27)..(27): n is a, c, g, or t
tgcgcccaatgccgacatacaccatgntcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccctgggcatggggccaggtctgtaacctgaagaagttgttttctgacaatcaccaaatcatccgaatgacatcaaaagcagcccttatctcagagaccgagatttctgtggtctcaacttcgctttggtataatttctggcactcaccagcctctatcattatgactttccccccagtgtattatttctctaataggtttccttttcacgttcttttagcacagactggcactttaccctctcaatttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacttctcaccgccccccacccctcactgcccccgattacactagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324982 - DNA, 3007 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaatgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagatgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgattttcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtgg

SEQ ID NO: 324983 - DNA, 3840 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaggagaaattgtaaaccgaaccatacttatctttttttgaagggggggcccggtccccaattcgccctat

SEQ ID NO: 324984 - DNA, 1715 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagtttgctgttgttggtattgaagacatcagtccttttcaaaaaaaa

SEQ ID NO: 324985 - DNA, 1638 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaa

SEQ ID NO: 324986 - DNA, 1496 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacagggaaaaaccagctctcacacctgctcctctgtaaagcgtcttccccaagcccacacgtaatttggtggctgtccttgaaagtatttcccaagatctccaaaccgctttaaacttccaaggtctgagcctgacctggcctcgctaacaaagggttccactgatgccgactctaagaagaaagttttcaagcttttaggtttgtttgaataagagatctgacctgaccggcccaactgtacaactcttcaaggaaaattcgtatttgcagtgggaagaataagtaacattgccgagatcacgccactgcactccagcctgggtgacagagtgagactccgtctcaaaaaaaaaaaaaaaaagaattagctgggcatggtggcacatacctgtagtcctagctactcaggaggctgaggcaggaagatcacttgagtccagaagttcgaggctgcagcaagctatgattgtgccactgcactccagcctgggcaacagagcaagattctgtctctaaaaataaataaatagtaaaaaataaaataaaatttgacttgaaaagcaaaac

SEQ ID NO: 324987 - DNA, 1585 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcaggaaaaaccagctctcacacctgctcctctgtaaagcgtcttccccaagcccacacgtaatttggtggctgtccttgaaagtatttcccaagatctccaaaccgctttaaacttccaaggtctgagcctgacctggcctcgctaacaaagggttccactgatgccgactctaagaagaaagttttcaaggttcttcgtatttgaactttctatggctaggcttatgtttaaaataaccacactgatttaaacatggtcttatagtcttcagtggctcccaggtcttgcctctcgggttttttttcctctttcctttgaatgtgccttaaccttcgtcttgcttttatttacctctgagtctggtttagagccacctggaaattgaatggaatctttagtctattagtctaatctagagtccttaccttctggcctttgctcattgcagagcccccacattattagtcagttgtaccacagatactgtgttacataaggtgaggagagggaggtggtgttatcagttccactttttccaggctagagtgcagtggcccgatctcggtgcactgcaacctctgcttcccgggttcaagcgattttcctgcctcagcctctcattttatcttggataaaagagaagctttgaaagattgcctccctatgtgtacagtcactgtaggcatgtatttgtgtactgtttacttagtcatgtcaatgagggcaataaaaaacaaaaatcag

SEQ ID NO: 324988 - DNA, 330 bp, Homo sapiens
acagaatgttcaggggggtaagggttggaataactccagatggcactggagacaagtagtgtagagacacaaatgggatcctctccctcctctgacatccagaatccagaatctctgggtctttccacttgggttgtgacctacaagttgggggcaaagctctttagctctcataatcagcaggactgatggcggaagctgggcagggctccctggaggcccagtgttgggctggcatgttcagcaccagataggtgcctatctcacaatatccctttttcatttcaggcacagatgaatccttcatatttatctggatttagctggtag

SEQ ID NO: 324989 - DNA, 237 bp, Homo sapiens
acacagcaacatccctgatgcagattgatgacaatgtgatgaggtgtgtccgcgcaggcgggagagggacgctctggggcagggtgccaggcaggaggctgcaggtcagctgtgcccagcactagtgtttgctctgcctacttgagtgttaagggtgtttttttccctttaagtaagtgtctagtgcttaaaaacagaagatttcacaggaacatttaaatttctagtttctcctgg

SEQ ID NO: 324990 - DNA, 3771 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaa

SEQ ID NO: 324991 - DNA, 3592 bp, Homo sapiens
  misc_feature (66)..(66): n is a, c, g, or t
aagttataatttagtatgagaagtatttaaaggtaaataaattgtaaaaaacatagagataataanatagatatttttttattcaagagagccagcccactgttggcatttatcagagtttatttaatcttctcatcaactactattgttaccctcagttgccaagtgaagggagcatgcgggaaggttaagtgacttgcccaagcccacacaaccggtaggagccccaattccaggccctagttccaaggctacattcttccaggcggcctccaactgggttggttaagggttgaaaggacagtgggacaataactgaggcccgtattgcccagagcgtccccatcccccgtccggagctggaagaggccatagaccgctgcctccacatcttttcctctccttcgggttcggtgactcacgacccttcttcctctctcccgggatatgacctcaaatttcaccccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccagggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacctgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagatccaacttttgaattgtttggtatcaaagttaaagttagaggtacttggtttt

SEQ ID NO: 324992 - DNA, 4785 bp, Homo sapiens
  misc_feature (1954)..(1954): n is a, c, g, or t
  misc_feature (3196)..(3196): n is a, c, g, or t
  misc_feature (3217)..(3217): n is a, c, g, or t
  misc_feature (3370)..(3370): n is a, c, g, or t
  misc_feature (3396)..(3396): n is a, c, g, or t
tggcgatacattcacacaggaacagctatgccatgtttacgaattccggttttgaaaaaactttcgttgacagttacacaaagggtcacttcctccccagcgacacatgggcctctcaaaggagaggagggagtaagtcccacggtagggccagtggttgctccctgggttttggaatcatttctgcggagctttcaaggccagaccctgggcttagggtcgagactttatagcagtgacagccagacccagcaagatggctgcgaccgtgaaaccctgggcggcgatccgggtgcgcatcatgagctgagagcgctggctgttgccccggtggaaggagtagaggccgtaggtgagggcggccgccgtggccaggcaacctatgggtaccaccgggttcaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggnagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtanctaggaacatgcactagatgncagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcnaagctctgacgatctaagatacaatnaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacc

SEQ ID NO: 324993 - DNA, 2458 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatattaa

SEQ ID NO: 324994 - DNA, 3703 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgccctgggaaaggggagtgcccaggccacagaaactctccgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatatggatccatacagctctataatcaaggctgagaactgtaacaaagttcatcgggcttatagaggggagtggagtgggataccaggaaaggaagtaaacagtttaaaagtagcaaatggggctgagcatggtggctcatgcctgtaatcccagcactttgggaggcccaggcgggtggatcacctgatctcaggagtttgagaccagcctggcaaatatggcaaaaccctatctctactaaataatacaaaaaatagccaggtgtggtggcgggcgcctgtaatcccagctacttgggaggctgaggcaggagaatcacttgaatccaggaggcagaggttgcagtgagctgagatcacgcctttgcactccagcctgggtgacaagagcaaaactccatctcaaaaaataaaaaaaggaacagatgggttcccctcactctcccacccccagaagcagtagttctaggaatcacatggttcgctttaaaaaaatcacctcccagctctcacttgagatcagttaaagcagactttttggggctgggaccagtgattggtgcagccaagctagaggaccatcgctttcaaggaatggttctcaaagaggggtgttcagtttcagcatcaccgggaacttgttagaaatgcaaatgcttgggtaggccagcctcactgaatcagaaactctgggggagaagcccagcagcctatgttttaacaagctctctaggagatgctgaccgcttgccctggtttgagaagcactgctctgaaaaaggagtcaatgcttaccgttttcccttcagagatagttgcccaaaccccttcttgcacacagcccttgcccctctccagagtatgaaaaggaggtatgaattcagcatgtatctttcccctaccttcaagctcacccttggaagcccatgggtggaaaatctcagtcgagatcaagacacgtgtggagcttgagttggttttgctaggaagataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatattaa

SEQ ID NO: 324995 - DNA, 2226 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatattaa

SEQ ID NO: 324996 - DNA, 2404 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatgagaatctgaatgttttctcattcacaaaagtatcccttctacccctatctggcgcagggctgaaatgtcatcattagaggttctgaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatattaa

SEQ ID NO: 324997 - DNA, 5941 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgccctgggaaaggggagtgcccaggccacagaaactctccgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatatggatccatacagctctataatcaaggctgagaactgtaacaaagttcatcgggcttatagaggggagtggagtgggataccaggaaaggaagtaaacagtttaaaagtagcaaatggggctgagcatggtggctcatgcctgtaatcccagcactttgggaggcccaggcgggtggatcacctgatctcaggagtttgagaccagcctggcaaatatggcaaaaccctatctctactaaataatacaaaaaatagccaggtgtggtggcgggcgcctgtaatcccagctacttgggaggctgaggcaggagaatcacttgaatccaggaggcagaggttgcagtgagctgagatcacgcctttgcactccagcctgggtgacaagagcaaaactccatctcaaaaaataaaaaaaggaacagatgggttcccctcactctcccacccccagaagcagtagttctaggaatcacatggttcgctttaaaaaaatcacctcccagctctcacttgagatcagttaaagcagactttttggggctgggaccagtgattggtgcagccaagctagaggaccatcgctttcaaggaatggttctcaaagaggggtgttcagtttcagcatcaccgggaacttgttagaaatgcaaatgcttgggtaggccagcctcactgaatcagaaactctgggggagaagcccagcagcctatgttttaacaagctctctaggagatgctgaccgcttgccctggtttgagaagcactgctctgaaaaaggagtcaatgcttaccgttttcccttcagagatagttgcccaaaccccttcttgcacacagcccttgcccctctccagagtatgaaaaggaggtatgaattcagcatgtatctttcccctaccttcaagctcacccttggaagcccatgggtggaaaatctcagtcgagatcaagacacgtgtggagcttgagttggttttgctaggaagataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccacttctccaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaacaaaaaaaaaaaacacaacatctataaaatcaaaacacaaacaaacaacaacaataaaaataatatatcacacaccactactatcaccacaacaatactaccacacataaaacaacttcaaaacaacacgaaataaaaaaaatgttcttgcgcccccactccttccgctcggagcgtttctctcacaccacactcaccatctgtctgccgcagccgcacgcacaacacctatcaaatatataaatatacaccaacatcttcataaatttgtcctagtttcatgataccaaatcaactcatgaatccctctacatttaactacaaaccatgtcgtgatgtcatgtatttctatctttcacaccccataaaactcaaatccaactctcagcgcaccttcgctataccaaccacaaacttctttgttctttctttaacatcaatcacacaacatctccaaagtgaagcttctcatcgtatccgttctatcactatcgatcttagactttctatactcatacaccaatgccgccgtatcatcgcacgagcaatctactatattaataatatttcaccg

SEQ ID NO: 324998 - DNA, 5215 bp, Homo sapiens
  misc_feature (3626)..(3626): n is a, c, g, or t
  misc_feature (3647)..(3647): n is a, c, g, or t
  misc_feature (3800)..(3800): n is a, c, g, or t
  misc_feature (3826)..(3826): n is a, c, g, or t
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgccctgggaaaggggagtgcccaggccacagaaactctccgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatatggatccatacagctctataatcaaggctgagaactgtaacaaagttcatcgggcttatagaggggagtggagtgggataccaggaaaggaagtaaacagtttaaaagtagcaaatggggctgagcatggtggctcatgcctgtaatcccagcactttgggaggcccaggcgggtggatcacctgatctcaggagtttgagaccagcctggcaaatatggcaaaaccctatctctactaaataatacaaaaaatagccaggtgtggtggcgggcgcctgtaatcccagctacttgggaggctgaggcaggagaatcacttgaatccaggaggcagaggttgcagtgagctgagatcacgcctttgcactccagcctgggtgacaagagcaaaactccatctcaaaaaataaaaaaaggaacagatgggttcccctcactctcccacccccagaagcagtagttctaggaatcacatggttcgctttaaaaaaatcacctcccagctctcacttgagatcagttaaagcagactttttggggctgggaccagtgattggtgcagccaagctagaggaccatcgctttcaaggaatggttctcaaagaggggtgttcagtttcagcatcaccgggaacttgttagaaatgcaaatgcttgggtaggccagcctcactgaatcagaaactctgggggagaagcccagcagcctatgttttaacaagctctctaggagatgctgaccgcttgccctggtttgagaagcactgctctgaaaaaggagtcaatgcttaccgttttcccttcagagatagttgcccaaaccccttcttgcacacagcccttgcccctctccagagtatgaaaaggaggtatgaattcagcatgtatctttcccctaccttcaagctcacccttggaagcccatgggtggaaaatctcagtcgagatcaagacacgtgtggagcttgagttggttttgctaggaagataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtanctaggaacatgcactagatgncagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcnaagctctgacgatctaagatacaatnaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacc

SEQ ID NO: 324999 - DNA, 1628 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaaggtgagcctgcaatgaacacttgtcctggagatgctggaaaatcttggctgagttgggaaaattgatattgcggaaccttcaccttcttctcccaggatagagagcctagcagctagttcctcaaaaaggcattatttaaaataatatctaccatcttagttagatctattccaggaatctctgatccgaaatgaccccactggccactagggtggcttgaggaggagagtcgtgaatctgcattttagaaaggtctctggcgggcacgcccagcctcatgagcacgcctcccatgccgtcacacagggccctgtgcacagaagggcctcatgcttggtttaataaacatatgaaactatttttcttctgtttatttttttaacctactaccaaggcaaagaagaatgtatgaaaattttaatttgttttaaataagggtccccgtattttcattttgccccagacctcacaaattatgctgctgggcccacttgcgggaagaggctatgtcaaaggcaaataaagacggaacaaataccacaggcaaaa

SEQ ID NO: 325000 - DNA, 380 bp, Homo sapiens
ggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatatt

SEQ ID NO: 325001 - DNA, 396 bp, Homo sapiens
gtaatttctgtatttcctgcataaactgtttctgctttgcttgctaatctctctctctttctcttcctctctctgcttccttcctctgtatctcttgatccctctttgatcttcaccatggtggcagaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacact

SEQ ID NO: 325002 - DNA, 4124 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccacttctccaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaaca

SEQ ID NO: 325003 - DNA, 4422 bp, Homo sapiens
  misc_feature (1591)..(1591): n is a, c, g, or t
  misc_feature (2833)..(2833): n is a, c, g, or t
  misc_feature (2854)..(2854): n is a, c, g, or t
  misc_feature (3007)..(3007): n is a, c, g, or t
  misc_feature (3033)..(3033): n is a, c, g, or t
attccggcacagggacacaaacaagctcacccaacacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggnagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtanctaggaacatgcactagatgncagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcnaagctctgacgatctaagatacaatnaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacc

SEQ ID NO: 325004 - DNA, 2479 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgagacctacattcatgtctttcaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatattaa

SEQ ID NO: 325005 - DNA, 2406 bp, Homo sapiens
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctaaaaaatattaa

SEQ ID NO: 325006 - DNA, 5853 bp, Homo sapiens
  misc_feature (3076)..(3076): n is a, c, g, or t
  misc_feature (4264)..(4264): n is a, c, g, or t
  misc_feature (4285)..(4285): n is a, c, g, or t
  misc_feature (4438)..(4438): n is a, c, g, or t
  misc_feature (4464)..(4464): n is a, c, g, or t
gctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgccctgggaaaggggagtgcccaggccacagaaactctccgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatatggatccatacagctctataatcaaggctgagaactgtaacaaagttcatcgggcttatagaggggagtggagtgggataccaggaaaggaagtaaacagtttaaaagtagcaaatggggctgagcatggtggctcatgcctgtaatcccagcactttgggaggcccaggcgggtggatcacctgatctcaggagtttgagaccagcctggcaaatatggcaaaaccctatctctactaaataatacaaaaaatagccaggtgtggtggcgggcgcctgtaatcccagctacttgggaggctgaggcaggagaatcacttgaatccaggaggcagaggttgcagtgagctgagatcacgcctttgcactccagcctgggtgacaagagcaaaactccatctcaaaaaataaaaaaaggaacagatgggttcccctcactctcccacccccagaagcagtagttctaggaatcacatggttcgctttaaaaaaatcacctcccagctctcacttgagatcagttaaagcagactttttggggctgggaccagtgattggtgcagccaagctagaggaccatcgctttcaaggaatggttctcaaagaggggtgttcagtttcagcatcaccgggaacttgttagaaatgcaaatgcttgggtaggccagcctcactgaatcagaaactctgggggagaagcccagcagcctatgttttaacaagctctctaggagatgctgaccgcttgccctggtttgagaagcactgctctgaaaaaggagtcaatgcttaccgttttcccttcagagatagttgcccaaaccccttcttgcacacagcccttgcccctctccagagtatgaaaaggaggtatgaattcagcatgtatctttcccctaccttcaagctcacccttggaagcccatgggtggaaaatctcagtcgagatcaagacacgtgtggagcttgagttggttttgctaggaagataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggnagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggtttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtanctaggaacatgcactagatgncagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcnaagctctgacgatctaagatacaatnaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacc

SEQ ID NO: 325007 - DNA, 740 bp, Homo sapiens
ttcaactgttccttcacctgtagcatggggcagtctcttagatcaagtctaaggtagacacaggtccgtccaggtatggagtggagaggagccgtcttcaggggtgtcagaatagcagaggcttctcagccggggatgaggaccaataacagctttgtgttctagattgaaatcccgattgttgaccacagcacctgccagaaggcttatgccccgctgaagaagaaagtgaccagggacatgatctgtgctggggagaaggaaggtgggttaagaggctggcatacaacaggggcgctgccagccagggagtggtgcagagccagcaagggagcacagaggcctcccaacctggtgggctggcagtgtgggggcgcgggggactggaggaaggccgtgggaggagggattccacaggagaagatgcatcggagaaaagatatttacaggatgctcatcattcccttcccaagttcagtgtttcccttaagaaagaggccttggccgggcacggtggttcatgcctgtaatcccagcactttgggaggccgaggcgggtggatcacctgaggtcgggagttcgagaccagtcttgctaacatggcgaaatcccatctttactaaaaatacaaaaattagccgggcatggtggcaggtgcctgtagtcccagctactcgggaggctgaggagggagaatcacttgaacccaggaggtagaggttgctgtgagccgagatcg

SEQ ID NO: 325008 - DNA, 1671 bp, Homo sapiens
gttcaacttttgttttctacccttctagacattttgtgcgtatatgtacacatatgtgagtagtaaatgagcacttaattagaataatagacctttctcattagtatgagttcttttacttcctgtaaacaagcacactaaaaactttaattttttcagatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaaaaaaaaac

SEQ ID NO: 325009 - DNA, 3022 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaaccca

SEQ ID NO: 325010 - DNA, 483 bp, Homo sapiens
cattccacagtaacatttaaataataaaaaatcatgggtaactaatattccctctaacttatttgcagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaactttaacaata

SEQ ID NO: 325011 - DNA, 3148 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaaaaaaaaac

SEQ ID NO: 325012 - DNA, 3273 bp, Homo sapiens
agcggagttggtagaggggcgcgtaaaacaattctcgagcaaaagtgcttctcgtctgccgaggatgtagctcccaagtcagactcctgggggactcctcaggctggctttcgccgtcgggtatcggttgtgtaacagctctgccctagttatctctttgtggggcgaggatccttccattggcgagccgttttaaggtgccgtgagatcttgtgtgaagaaacccgttggcatagcccaaaccgaagcccccaaagggaggagagttgctggcctgacatcagctgctcttaaataaggatccccgccccctcctgtgttccccggtggagctagttgaagaggagtcctcctgttcgtgctaatttagagcagaagcagccatcgataaataccatgccatcttctaagggcactgtgcgcctctgttattaagaggagctctttgttctgtccttggtgtgtggtgcattcgtgaaattctgcagcacatcggcgaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaaaaaaaaac

SEQ ID NO: 325013 - DNA, 3116 bp, Homo sapiens
ttacgatattaagttgaacgaatggaagatggtctcaccaatgccatggaagggtgtaccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaaaaaaaaac

SEQ ID NO: 325014 - DNA, 1836 bp, Homo sapiens
  misc_feature (1790)..(1790): n is a, c, g, or t
  misc_feature (1795)..(1795): n is a, c, g, or t
  misc_feature (1836)..(1836): n is a, c, g, or t
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttagttcggtaagcattaggaatgccattgcgattagaatgggtacatgaggagtagagntgcangggtatgtgaccgatatcgtggtccgagccgatcgtatcan

SEQ ID NO: 325015 - DNA, 1310 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaactttaacaataaaaaaaaaaaaaaaaaaaaaaaaaaggggggagagagggaagagagcagaaccgacacgcacaccacaggcaaacgagaagagcaaacatgaccaacaagagacgacacaacgacgaacactaaacgagagacgacaacaaccagtccacaccgcagcgccaaccacaccgcaaccacaagacgctgacccacaacaacgaagtgacacggcgcaaccacgcggcaatcacagaggagccagccgcagcagacgataacaaacacgagagagaccgcacagaagcagcacaagaaaaacatacaaccaaacgcaacgcaga

SEQ ID NO: 325016 - DNA, 862 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtaagaaatatcagattcctgttgtgtgttta

SEQ ID NO: 325017 - DNA, 989 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggagaagcagaaaaagttgatcagagccttccagagtgtggtatgcttttcactgtgtgatgatccttagtggcacatgaatgaacgtccagatgtttgtgcagtagcccacccttatctgcaggatacgttccaagacccccagtgaatgcctgaaactgcagatagtactgaatcctatatatactgtgttttttatgatacatacatgcctatgatgaagtttaatttctaaattagacagtaaaagattaacaacaataataataaaatagaacaactttaacaata

SEQ ID NO: 325018 - DNA, 3279 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaaaaaaaaac

SEQ ID NO: 325019 - DNA, 3404 bp, Homo sapiens
agcggagttggtagaggggcgcgtaaaacaattctcgagcaaaagtgcttctcgtctgccgaggatgtagctcccaagtcagactcctgggggactcctcaggctggctttcgccgtcgggtatcggttgtgtaacagctctgccctagttatctctttgtggggcgaggatccttccattggcgagccgttttaaggtgccgtgagatcttgtgtgaagaaacccgttggcatagcccaaaccgaagcccccaaagggaggagagttgctggcctgacatcagctgctcttaaataaggatccccgccccctcctgtgttccccggtggagctagttgaagaggagtcctcctgttcgtgctaatttagagcagaagcagccatcgataaataccatgccatcttctaagggcactgtgcgcctctgttattaagaggagctctttgttctgtccttggtgtgtggtgcattcgtgaaattctgcagcacatcggcgaaagtgatttaaatctaccacccagctgtagttgaatctacaatctgctcagggatttatactcaatgccaatttgatatcatgctgggagggactgattgcagaaccttcttgacaagccacataaatctaaagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacatggactgagctgtgtccaatgattgaagccaggaagaatcatgggctggtatttgtaaaagacaagatatttgctgtgggtggtcagaatggtttaggtggtctggacaatgtggaatattacgatattaagttgaacgaatggaagatggtctcaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgtttggtaaagaaagtttcaagtgaaatgaggttcctataaaatagatgtttcttttatatggatttccttaattcaaagatcatattttagctggccacaaaaccaagaacatatctagcaagaaaacttgaaaaagtataagcatttgttaaaaatgtgaatttcttgaatgaatttcacatttgtaactatgattttggcagaatagaagattggctcatcagtgaagcgcagtatcttagctctagattctattttcatgcatcacagaagtgctatacggttaggtctgtttgtgctcagtcaagaactaagaaatagtatgaattgtaagtcaagatgggcaactcagatggagcagcttagtctcacagtttgcttgtctatttattttatttagtgccaaatgtattccattttaaaagtaagccagagtgagtcaaggcatatacacactttctcacaaaacttcctaaacagatttgggggtttaatatgtccaactcctcatgaaatatattcaatccacttaaatatattccatctttttaacataaaatgtaaagcttagcacccatcattaatttatgtctctgttttatccagtggttaaaaaaggattctgcctctttagtcctcactgttaaataaaacccaatcatagtaagtgattaactagcaaaaagtaaagctatttatagcaaatttctagatcattagaaaagcactggtagttgtacaatatcagtgttgactttgaacttctttaacgagatcatgaattcttttcccttagccaaaacatgaaatatttaacctagttgtctctaaaagttttgtaatcatgagttagatatatgtcatctcctattcattgcttttatgtgatcaataaatcttttacaaacccaactactcatttccttcctagtaatactttgcctttttcactgtgtatggaatgaaacatgtaaagctgtcacaatcaatgtttttatctgataatattaaatattttttaacttaaaaaaaaaaac

SEQ ID NO: 325020 - DNA, 1701 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgatatccttgctaaagtcaggtttcctcttatatcaaagaatttcttaagtaaaacggtacaagctgaaccacttattcaagacaatcctgaatgccttaagatggtgataagtggaatgaggtaccatctactgtctccagaggaccgagaagaacttgtagatggcacaagacctagaagaaagaaacatgactaccgcatagccctatttggaggctctcaaccacagtcttgtagatattttaacccaaaggattatagctggacagacatccgctgcccctttgaaaaacgaagagatgcagcatgcgtgttttgggacaatgtagtatacattttgggaggctctcagcttttcccaataaagcgaatggactgctataatgtagtgaaggatagctggtattcgaaactgggtcctccgacacctcgagacagccttgctgcatgtgctgcagaaggcaaaatttatacatctggaggttcagaagtaggaaactcagctctgtatttatttgagtgctatgatacgagaactgaaagctggcacacaaagcccagcatgctgacccagcgctgcagccatgggatggtggaagccaatggcctaatctatgtttgtggtggaagtttaggaaacaatgtttctgggagagtgcttaattcctgtgaagtttatgatcctgccacagaaacgtatgtatctatttaaaatttattttacagttaactgtattctataagctctgtaggagatgtca

SEQ ID NO: 325021 - DNA, 1273 bp, Homo sapiens
tcctgggcagggctggggttctgcccggggacgcagcccagttggtagcgtcgctccctgagcgtttctaagggggccgcccggccttgtctttcggcagtggccgagccaccgccgcctgccgcgcgttccagagctgggcgctgcagctgcactgccgatcgccgtgtttggtcgatagaatccccagtgtgcccagagagtgcgacccctcgcccggcccggcgagccccgggcgtgaaccgagctgagggaggatggcagcctctggggtggagaagagcagcaagaagaagaccgagaagaaacttgctgctcgggaagaagctaaattgttggcgggtttcatgggcgtcatgaataacatgcggaaacagaaaacgttgtgtgacgtgatcctcatggtccaggaaagaaagatacctgctcatcgtgttgttcttgctgcagccagtcatttttttaacttaatgttcacaactaacatgcttgaatcaaagtcctttgaagtagaactcaaagatgctgaacctgatattattgaacaactggtggaatttgcttatactgctagaatttccgtgaatagcaacaatgttcagtctttgctggatgcagcaaaccaatatcagattgaacctgtgaagaaaatgtgtgttgattttttgaaagaacaagttgatgcttcaaattgtcttggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtttatgatgctgcagtcaggtggttgaaatacgatgaacctaatcgccagccatttatggttgcagctgagaagcttccaagctttggggcctgggcagagctaaactggggaaaggcttccagcctttctttttcagatcatcagttgtcttcctaccaccggactttgttgcctttccagagtagaagaaaaacagaaaagacggttgaaaaataacataaaactaagcttaaaaattttacatccaaaagaaaatgaattacaaaatacaaatgaagtgcacagccaaagccaccacaaagggccaggccaacttcttactgaaaatttagaaatgattatacctaaatctggaaagaataactcccaaaggaataagcctaagcaacaattag

SEQ ID NO: 325022 - DNA, 336 bp, Homo sapiens
gaaatttactcaactaattttcctgaagtcatgcttcatcttgaatgtatacttggtttttctaaaaatgattttctattcttttattttctttctgtgtttaggtataagtgtgctagcggagtgtctagattgtcctgaattgaaagcaactgcagatgactttattcatcagcactttactgaagtttacaaaactgatgaatttcttcaacttgatgtcaagcgagtaacacatcttctcaaccaggacactctgactgtgagagcagaggatcaggtgactaaattgccttctcacatttttcttaataaaaatgtctttattggtttctt

SEQ ID NO: 325023 - DNA, 655 bp, Homo sapiens
acactaacaccagtattggttttagctctattttttgtaccaccatatggatttgtacattttcccccaaacctggtcacctattgccaaagactgggactttttacatcccatggagaagtttcccagcatgattgatcacccactggaaaactctaatattgtacagtgggctcttgaaagtgaagcaaagattattcttggtgaaggaggaattggacaagccctgaagataaaattttgcctggagaagtggtaatatgtataacttgataatatgagagtcagaggacagtaatctcacacgttttagtggcattaattagggcaggcataggaagataggaaagactgacttggaggctgttaaagtatttcatgaatgaagtaaagaagattgcagggggccccttaaataacagcaataggaagagataggaaagaatgtgaggcattttgaaataagtagcaaaacttattgactcgctcactggatatgggaaatggaggagatgtttgaagataacttcaggtttttaagactaatcagagaaataatgtcactaacagacagtgaaattgagtttatttgagttttctaaacaagtgagttaagtttagaaagtgccttacttaaagcataagtaagatatat

SEQ ID NO: 325024 - DNA, 806 bp, Homo sapiens
cttctccctgccctctttctttcagaaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtg

SEQ ID NO: 325025 - DNA, 1030 bp, Homo sapiens
ctctattttcataagcactctgtatgtggacgattttaatcctctaaacagtgttatgaagtagataatattaatagatgaggaaactgagacaaagattggtaacttgttcaagggcacagtggagccaagattcaaactcgggcagtttgtgtccagagtacaccctttgaagaccaccaagcttataacttttctcatatataataatttttgccctgaattacagaaagatctgaagccaggatcgctcaggagacgatggagagagctcctagcagagttgggacggttctcagtgtgccccaatgttgcagttgtttttcagcatattctgtctttctcctcagtcaaggaccaacctaccttttcttttctagtgctgaggaatgtaaacaagtttgctgggccttgcgagacttcaccaggttgtttcgatagctcacactcctgcactgtgcctgtcacccagggtgaggatacatagttcccagcttttgtccggactgtcggactgttggggatgcctgggaatggggataggttttaatgcctatcatgggaccagtcttatagctagagtcagggaaggactcagcagtttaactgtggtgaacagctggaatatacagggcccggattttcttgggcctgggcagccagtaattgtcagtgtctttggggtaccattttcacctccataagaaagtaactgttacacagtgcattgaaacattttcttcccccttccccttacagacacttctaagatggtaagtgtacatggcaacaaacaaataagtatttttaacctggccactttggcgaaaacaacctcaagttgactgttatatgtggtgccagtctcctaaaactgaccctccagatgtaatgagcaaagagcttattcttatcacttttatgacctgaatgctgaagtgccaggttttgaccagggcaggaggtatgaattgaatatcccttatccgaaatgcttgggatttcggaggaaaaaacactttcagaagtg

SEQ ID NO: 325026 - DNA, 527 bp, Homo sapiens
ctctattttcataagcactctgtatgtggacgattttaatcctctaaacagtgttatgaagtagataatattaatagatgaggaaactgagacaaagattggtaacttgttcaagggcacagtggagccaagattcaaactcgggcagtttgtgtccagagtacaccctttgaagaccaccaagcttataacttttctcatatataataatttttgccctgaattacagaaagatctgaagccaggatcgctcaggagacgatggagagagctcctagcagagttgggacggttctcagtgtgccccaatgttgcagttgtttttcagcatattctgtctttctcctcagtcaaggaccaacctaccttttcttttctagtgctgaggaatgtaaacaagtttgctgggccttgcgagacttcaccaggttgtttcgatagctcacactcctgcactgtgcctgtcacccagcaggagtgtaacaggtcgcgccacgtgaatctcgattcatggtaatagctttttc

SEQ ID NO: 325027 - DNA, 4621 bp, Homo sapiens
  misc_feature (4617)..(4617): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325028 - DNA, 4337 bp, Homo sapiens
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacataaaaaaaaaaaaaaaaaaaaaaaaaaaaaaaaaaaaaaaaaaaaaaaaaaagggggggggggcaaaaaatacaccccgggggggccccattcgggcccccccgttttttggaaaaaggggggcccccatggggggcatttaaaaagacacgaggcgcgggccgagcccgggcgataaacaagagcgccgggtgcgacggggaaaccggtggtggccggcgcggacaactggtggaggaggaaccccactacactttggggggcggctgaccacatagttggggccaacatcacacccacaaggaagtacgtacacgcaccgagaggggacaaaactaacaactacgggggtgtctagcgtcgttaacaaccaaacgggcaattatgacggccgaagcgacaagtgtgggctgacgagacagcaattcgcgaaccaaattatttctcgccagaggcgtcgtctaagaaaccggggacgacacgacagcaaggtgcagtcgaggccacgaagaagacgaaaacgaaccaagagaacagcaggagaggaagaacgaggaggagcagaaaggcgagagtgaaacgaagcaagcaaagcacgcagaagcaagaaggaagccggaaagagaaagagcggagaagcaagaaagaaagaagaacaaacaaaagaaacgaaagaagagagagagaacgaggaaagagcaagacagaaaaaagaaacgcggagagaaaacagaaaagagaagcgagaacggaagcgaaaaagacaagacagaagcagcagacagcatagccgccgtc

SEQ ID NO: 325029 - DNA, 4723 bp, Homo sapiens
  misc_feature (1750)..(1750): n is a, c, g, or t
  misc_feature (1756)..(1756): n is a, c, g, or t
  misc_feature (4719)..(4719): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccaaagaagccctttagcaatgctgngtgtcntcacagcctgttatttggccagaatataacctctgaaatcagtaactgtgagtacttaccgcctgtactcagggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325030 - DNA, 4429 bp, Homo sapiens
  misc_feature (4425)..(4425): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325031 - DNA, 4452 bp, Homo sapiens
  misc_feature (4448)..(4448): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325032 - DNA, 2103 bp, Homo sapiens
  misc_feature (2099)..(2099): n is a, c, g, or t
gattctggagaccattctgctgttctagaagctgaaaggtggggatgcacagtgcctggaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325033 - DNA, 2953 bp, Homo sapiens
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttac

SEQ ID NO: 325034 - DNA, 1845 bp, Homo sapiens
  misc_feature (1841)..(1841): n is a, c, g, or t
tcaactgttattagtaggcaaagccttctttcaaaataaaatcgacatgaagcctgtgggatttagcagactgaggcaaagcttccctggttgctttggaatgggaggcctggacctgctggctctttgccctcctgacacatcatcccttgtttccacagcacactcagcattggaagcacactgcagacggtgtctcattaaagcagtagctcccttgaacccacaagttaaaacgccagacttttatttatttgtttattttttctgagttcttattggcagacttcagaatgaggtacctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325035 - DNA, 1589 bp, Homo sapiens
  misc_feature (1585)..(1585): n is a, c, g, or t
agaggatccccgtcggatgcaagtgtcagacttcagaatgaggtacctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325036 - DNA, 1772 bp, Homo sapiens
  misc_feature (1768)..(1768): n is a, c, g, or t
tgttttttaaggtttttttcttagtgaattattcacccacagacatgagagaaaaaaagagggagggtgtgtggagaaaaaaccacagcacactcagcattggaagcacactgcagacggtgtctcattaaagcagtagctcccttgaacccacaagttaaaacgccagacttttatttatttgtttattttttctgagttcttattggcagacttcagaatgaggtacctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325037 - DNA, 1481 bp, Homo sapiens
  misc_feature (1477)..(1477): n is a, c, g, or t
aaatgacacatgcacgcacacacacatacacgcacaagcgccagtgcgcacgtgtacacagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325038 - DNA, 1413 bp, Homo sapiens
  misc_feature (10)..(10): n is a, c, g, or t
  misc_feature (30)..(30): n is a, c, g, or t
  misc_feature (1409)..(1409): n is a, c, g, or t
acttaaaatnatttttccttttagaaagtncaccaggaaaccagctccccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325039 - DNA, 257 bp, Homo sapiens
ccttggctcgacactgccagctggaaccagaccatgtaagttcccttctctacctcttcaaatcttaatttcttcctcttgtcagtgccaacttgaaaaggaactgagaagatagataataaacctggctgggcaccctggctcatgcctgtagtccagcactttgggaggccaaggcagatgaatcgttagagcccaggaattcaagaccagcctgggcaacatagggaatcccctgtctctacaaaaagaaataa

SEQ ID NO: 325040 - DNA, 411 bp, Homo sapiens
tgcccctctgtgcacagtttccaagagatgcagatgcccaagtcccttatataaaatggtgcagtatttgcatataacctatccacatcttcccatatactctaaatcacctgtaaattacttataatacctaatacaatgtaaatgctatgtaaatagttgctatagggtaatttttaaatttgtgtttttcattgtattattatttacttatattttgaatattttctatcgatggttgattgaaccctagggtgtgcagggccaactgtagatcactccttagtgatcatacttcttgcttccctattcctgctacctccccagcaacaggataagacctcgtctaacctacatgaagctgcttcggactgtgtatgctcagctctctatgccattgagaatgtggag

SEQ ID NO: 325041 - DNA, 4782 bp, Homo sapiens
  misc_feature (4778)..(4778): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcgcctctttgaaatgtgctgctagtgggagctgcagcttcctcctgctgactctgagccccaggcttcagttgagatggtcctttcagaaatgtggagcttagtccaagcctggatttcagtgggtagcacctggcatctgtggctagaaagtcctatgaagtgttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325042 - DNA, 3179 bp, Homo sapiens
  misc_feature (3175)..(3175): n is a, c, g, or t
atgcacagaaccagcagagtctccccttttcctgagccgagtgccaggaacactgtggacgtctttgttcagaagggatcaggttggggggcagcccccagtccctttctgtcccagctcagttttccaaaagacactgacatgtaattcttctctattgtaaggtttccatctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325043 - DNA, 4861 bp, Homo sapiens
  misc_feature (4857)..(4857): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccagccacagcacactcagcattggaagcacactgcagacggtgtctcattaaagcagtagctcccttgaacccacaagttaaaacgccagacttttatttatttgtttattttttctgagttcttattggcagacttcagaatgaggtacctgaggaaatatagaaacctctgccttaaggttgattttactaaatgctctattttctggtgcagttattgactgtcttatctcttttgtcaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325044 - DNA, 4529 bp, Homo sapiens
  misc_feature (4525)..(4525): n is a, c, g, or t
atcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaagaagagggtcagggtcatttgttcaggttttctattgttttgtcctctctttcctctcctacccttccttctctttctctctcccctccttttaaatgcaaatgagtagaaatttcttctaccttccccagctgtttcttcccacctttagagttgtttagacaaggaggagtaagcaaggaacttgttctgctttctatcgtggtcacattggtgatgctcgggacctgccagggtcagaatttatggatatctgaaccctgaccccgttcattctctcagtccacttccaatccacatcagtttgttgtctgccttggagagaagagccaaaactggggtgggcgggtgggtggggagtgcaggatataaatgtgtaagtttttgttttttaaggtttttttcttagtgaattattcacccacagacatgagagaaaaaaagagggagggtgtgtggagaaaaaatgtttacagggctaacaagggatgatgtgtcatttagtatgttactaaaaagtgtggaaatgacttgattttaaggggagggtgaggccgaagagggaagcccaaagcagatcttaatgtttcaaaggagtgcagcccttcacagccatcagatatgagggcactgttctgtctggtgttgtagccatctcaagaacaaatcaacagcaacaaaagagaaagaataaatttttaaaatttaaaaaaacaagaaaacaatcgagggggggccggtccccaatagcccataggggcgcataaactccaggccgccgtaacacgccggcgggaaccggcgtcaccccggagaccacccccgccggaactgaacaagacagacacccacccaaccccccgacagagacaccaccagataaccacagcataacattacaggcgcacaacaaagagtatcggagagacagaacatatcagggaggcgaggagncggc

SEQ ID NO: 325045 - DNA, 449 bp, Homo sapiens
gacattctgggaaatatcagtcaggaatgctgatcccgtttcagtcttagcatgctgtatgatcttgagagagtgtcttaacctctctggggtttgggctttcccatctgtaggggagcattcccggattgtctgggtgaacagctggcagatgagaaaggccagtggttgctactaagcagctgctgaatgaacacagcagtggggctgctgagggcatagtagaggcccagaatcagagtggactttccagatgtaagaaccataagcaatggagattttgagtcctacacgtgagtcagctgggctcattctgcatgtcctgcctggattgttgttcagggggtaccaatggctaactttgggggtccttgtctccgatcctcatccactcactttgcatgtgctgtgaatcgggctgaactcatatttctattttgcatccggac

SEQ ID NO: 325046 - DNA, 4864 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325047 - DNA, 4292 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325048 - DNA, 4776 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagccccggtctcagcaccttatctggactgacttcctggagtgtcactatagcccatgaagtaggtgctgctgtgaacctcattctacagctgaggaaacagaggacagagaggccggtgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325049 - DNA, 3841 bp, Homo sapiens
ggccagctctgctccctgcagtctgccctccggctgcgtgtggatgctgctcgtcctcgccctgtgggccctggtgccctgcctggcgttgttaaccctctactttttctcctccacaggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325050 - DNA, 3732 bp, Homo sapiens
caaccagtcagtgatatcccatactttataacttgcaagcccctggccccttcccatctactaacttcaatgatcctgtgaggtaggtgcaatcattcctatttcacaggctcaccctccaagggtccaatgagaagccgccccagtccctcttccctctggcttctttcccccaggaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325051 - DNA, 3547 bp, Homo sapiens
  misc_feature (21)..(21): n is a, c, g, or t
gcttgacgaggagagtagccntctcgctacattgcccagactggtctctgaactcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325052 - DNA, 1402 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaaccgtgagcaattccttctctctgtggtgcctgtt

SEQ ID NO: 325053 - DNA, 1399 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagaataagggaaatggggttcacggtaaggcttccagtcggggctgtatgagtcaacgacacgaccacacgcccgactttaggcatggatgtgtcgctggtctcaccaaccacaacggtgttcgtaccacggcaggttgccgaatatgttgatacga

SEQ ID NO: 325054 - DNA, 4831 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325055 - DNA, 4801 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325056 - DNA, 4692 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggcggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccatctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtacccttgaccctcctgggtgttggttggagcagaactggtgaggatgtttgatccgagattttctgagctctccccgatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgcggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttcttttttttttttcttttcttttttaaaaatatgtggctgtgaacttgaatgaacactgctcaaactttctgctattgggggggcgggtgggatgggaagaaggggcgtttgttttattcttggtgttttcagtgcaataaatagctacaaacttctgtgcaaaaaaaatg

SEQ ID NO: 325057 - DNA, 2308 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccaccccgtcgggtagagcgggaccgactga

SEQ ID NO: 325058 - DNA, 1628 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggacggcaaatggcagatcgtccacttccacagatctggggcgccctccgtcctgccccacagagagagcgtcggtaccgagctattat

SEQ ID NO: 325059 - DNA, 1477 bp, Homo sapiens
agccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagctatttacggtaacagcatttaggttacagctatttagtacagcattaggtacatctatttagtaacatccatttaaaaacgggcccagtt

SEQ ID NO: 325060 - DNA, 468 bp, Homo sapiens
gtgatctgcctaccatggcctcccaaattggtgggactacaggttatataatcagtatgtctgttattttacctttagctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtca

SEQ ID NO: 325061 - DNA, 630 bp, Homo sapiens
aatttggttacgaccatatttatcccatttttaaaggaattacatctattttgtctgtgtccaccctcagaatataagatctgtaaccactaccacaaaaggaagtaaggacatgcaaaacttcaaaaatgttctgatatatgatatacaataacattccaaaagagcataaagatttactgataacaaaaaggaaataagaaaatctaatatacagaatactcagttcaaaacgatttacttcacagtttaccactgggagtctttatatgcagtagaatgttgtaataagagttatttttctatggatctgatgttcttttcaattacagatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtca

SEQ ID NO: 325062 - DNA, 381 bp, Homo sapiens
ttagaggatcccctctctaagggacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtcacatcgtcacttagagaggggatcct

SEQ ID NO: 325063 - DNA, 837 bp, Homo sapiens
cttttggtgacgccagagagtgcgcgtcagcagtttattagagagctctgtagccagcctcttctgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtca

SEQ ID NO: 325064 - DNA, 585 bp, Homo sapiens
taacaaacagtatgtgggatttttttagatgtgttcaatttgaaagtaacttgtgaaacaactggtgatattttggtataagacgttttgaaagttatttgtttatttctaaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtca

SEQ ID NO: 325065 - DNA, 874 bp, Homo sapiens
gcgagccaccgtgcctggcctagaaaagtgtattacctttttaacatcattattctttactccatttttagttttgaattgcagtgtttgaccttaaaagttttatattacaatttttttaattagtcttttattttttccaagagacttctaattaaaagggaatagtaaataaaagcactgtgcttgccttttgtgcttttattaaagtgaaatctctacaatctttcctaagctgttaatcactgtttactaatgaacataaaccacttcctaattattcagactcaagaatttttttctagagggtattggggtaggcaaagatttgaaagtaacttgtgaaacaactggtgatattttggtataagacgttttgaaagttatttgtttatttctaaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtca

SEQ ID NO: 325066 - DNA, 1146 bp, Homo sapiens
aatttggttacgaccatatttatcccatttttaaaggaattacatctattttgtctgtgtccaccctcagaatataagatctgtaaccactaccacaaaaggaagtaaggacatgcaaaacttcaaaaatgttctgatatatgatatacaataacattccaaaagagcataaagatttactgataacaaaaaggaaataagaaaatctaatatacagaatactcagttcaaaacgatttacttcacagtttaccactgggagtctttatatgcagtagaatgttgtaataagagttatttttctatggatctgatgttcttttcaattacagatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtcaagtaattggatattttgaatacatttctgcctgataatcatgctgggttctaataagccctacttccacctaatctgtttacagtcttttggtatgtttcagttacttagatggtctcataaggtttctgatacaatttgaagacagaaatctgcatttagaatcagaaaacatggacatatttttcatatttatctagtcatatgtaattttatgctaacattgatagtttataaatccttttcatcctttgtgcctcggttattaaggaaaaaaaaatgtccaacatacagtttttaaagtgtggcagttttgagtagtaacttagaatgtataagattaagagttaaagaaaccgaacaataagtggcaaccaattatcttaacattggaaatactggggtgccattttgttttcaaaagttattcattgtaatccactgttttggctttcatgaacaagtaaattacagtgtataaatgaaaagcaatttcataataaattctataaactga

SEQ ID NO: 325067 - DNA, 888 bp, Homo sapiens
cttttggtgacgccagagagtgcgcgtcagcagtttattagagagctctgtagccagcctcttctgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggtttggataaatacatcagacattatattggttggtctacgggactatcaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtca

SEQ ID NO: 325068 - DNA, 1404 bp, Homo sapiens
cttttggtgacgccagagagtgcgcgtcagcagtttattagagagctctgtagccagcctcttctgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggtttggataaatacatcagacattatattggttggtctacgggactatcaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtcaagtaattggatattttgaatacatttctgcctgataatcatgctgggttctaataagccctacttccacctaatctgtttacagtcttttggtatgtttcagttacttagatggtctcataaggtttctgatacaatttgaagacagaaatctgcatttagaatcagaaaacatggacatatttttcatatttatctagtcatatgtaattttatgctaacattgatagtttataaatccttttcatcctttgtgcctcggttattaaggaaaaaaaaatgtccaacatacagtttttaaagtgtggcagttttgagtagtaacttagaatgtataagattaagagttaaagaaaccgaacaataagtggcaaccaattatcttaacattggaaatactggggtgccattttgttttcaaaagttattcattgtaatccactgttttggctttcatgaacaagtaaattacagtgtataaatgaaaagcaatttcataataaattctataaactga

SEQ ID NO: 325069 - DNA, 6392 bp, Homo sapiens
gtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctgggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaaaaaaatct

SEQ ID NO: 325070 - DNA, 2154 bp, Homo sapiens
acagatgcagccacacttgaggtgccactgaagctatgtgaagagcctgctacccttcaaacagaccaggcccaagcaaggtgccaagccatgtgagagtgcccagtccactgtgtaaatgtgacggcctttgatggtagtgtttgaaaagatacttagtagaaagttgcagagacccgggagcagccatttcacaaaagaaggcaaaaatacctttgagaagaaaggaatgtctgcctctgcactatgtatttgcttgtttgtttctccaaataccatctgttgcagactggggtgcatgacattttaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctac

SEQ ID NO: 325071 - DNA, 4586 bp, Homo sapiens
cggcccgggttactgcactgatcaacatctacaagcatctgatgatcacagctcagagattcacagtgcaaattgaggagaaactgctcctcaagctgctaagtttctttggctacgatcaagcagaatcagatttagaatttaagctttaagagtatttgggatcaagagcaagatcctgtctgtttaatgctgtgttttccactttgggttggaacgccagtgtttatttgtattcagacagccacttgggagcctgcctgccagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctgggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaaaaaaatct

SEQ ID NO: 325072 - DNA, 3313 bp, Homo sapiens
agcaggagcagccctggccatcactgtttctttgacgtgtacatcccatcctgagatgcagctgggctgggagccgccacctgggtggatctgattcctggatttccccatcctggggacaggtgacccatcctgttctcctccttaggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctgggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaaaaaaatct

SEQ ID NO: 325073 - DNA, 5128 bp, Homo sapiens
  misc_feature (5045)..(5046): n is a, c, g, or t
gctcggagcttctcgggaagctccgcctcccagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctgggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggacaaatttgannaaggaatgattggtttcaaatgatgggggaaagaagtaagttctgttttgttttgatataataataggttttaattggctat

SEQ ID NO: 325074 - DNA, 3162 bp, Homo sapiens
gctcggagcttctcgggaagctccgcctcccagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttc

SEQ ID NO: 325075 - DNA, 2594 bp, Homo sapiens
  misc_feature (2580)..(2580): n is a, c, g, or t
gctcggagcttctcgggaagctccgcctcccagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaacaagcgcctgggaatcctctngagcgcccgcagca

SEQ ID NO: 325076 - DNA, 715 bp, Homo sapiens
tgaggtgccactgaagctatgtgaagagcctgctacccttcaaacagaccaggcccaagcaaggtgccaagccatgtgagagtgcccagtccactgtgtaaatgtgacggcctttgatggtagtgtttgaaaagatacttagtagaaagttgcagagacccgggagcagccatttcacaaaagaaggcaaaaatacctttgagaagaaaggaatgtctgcctctgcactatgtatttgcttgtttgtttctccaaataccatctgttgcagactggggtgcatgacattttaggtaagtagcagatgaagatttatgaagctgggccctgaggtttcctctaaaatatttcttcaccttttaagtcaagacccaaaagtggggagagaagtaggagttggcagaacttgaaatatttaaactaatttagcaaagctcaggagtgttggagcttatctcgttatttaagttagataaggaggaaggggaatttgaaggataatgatagatcagtgtttaagaatacagccatcaggactgataatgttctggaatcccgggaccctcggattgtgcacgtagatgtaaattccatttgctctgagaacttttgaaaaagaaagtttttggttgatttcacagaaaagatttatggtgggcatatttgactttttcagtaaaaatagccccaaaacaccacccaaaatctgttaaga

SEQ ID NO: 325077 - DNA, 591 bp, Homo sapiens
gcatcagtcagagcgggagtacatcaggtaccatgcagccacaagtggtgaacaccttgtagccggcatccatggcctggctcatggtaagtcatgggtgacatcaggctctgctgctgctggtcctcagaggcgcctttgtatcaatctgattgcagctataaaaaaagaaaggtgggctgggcgcggtggctcatgcttgtaatcccagcattttgggaggcctaggagagtggatcatgaggtcaggagtttgagaccagcctggccaacacagtgaaaccccgcctctactaagaatacaaaaattaggccaggcacagtggctcaatcctgtaatcccagcattttgggaggtcgaggcgggtggatcatttgaggtcaggagtttgagaccagtctggccaacatggtggaaccccatctctatcaaaaatacgaaaattagacaggcgtggtggtacatgcctgtagtcccagctactcgggaggctgaggcaggagaattgctcgaaccctggaggcagaggttgcaatgagctgagatcgtgccactgcactccagcctggcaacagagcaagactccaatt

SEQ ID NO: 325078 - DNA, 5785 bp, Homo sapiens
gctcggagcttctcgggaagctccgcctcccagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctgggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaaaaaaatct

SEQ ID NO: 325079 - DNA, 3885 bp, Homo sapiens
ctttaaatcagaatttctttatctctagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctgggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttcccaaaaaaaatct

SEQ ID NO: 325080 - DNA, 4863 bp, Homo sapiens
gctcggagcttctcgggaagctccgcctcccagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaagtggaaacttggctttcgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcgcgagtttgaccatcagagcaatgcaaatcaaaaccacagtgaaataccatctaacaccagtcagaatgactattatt

SEQ ID NO: 325081 - DNA, 2381 bp, Homo sapiens
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaacaacaacacacacaaaaacaaacacatttttgggcgcatgtggcccacagaaagcttagaaccactcgtggcggcgggggcccctgtgggaagaacag

SEQ ID NO: 325082 - DNA, 2284 bp, Homo sapiens
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggactgaagctgtctttgggagccgttgcattccg

SEQ ID NO: 325083 - DNA, 600 bp, Homo sapiens
actcgctattcatcggcacctcgctattcatcggcacttcgctattcatcggcacctcgctattcatcggcacttcgctattcatcggcacccttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatctt

SEQ ID NO: 325084 - DNA, 2328 bp, Homo sapiens
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaattttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttaaaaaaacaacaacacacacaaaaacaaacacatttttgggcgcatgtggcccacagaaagcttagaaccactcgtggcggcgggggcccctgtgggaagaacag

SEQ ID NO: 325085 - DNA, 2276 bp, Homo sapiens
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatctt

SEQ ID NO: 325086 - DNA, 914 bp, Homo sapiens
  misc_feature (822)..(822): n is a, c, g, or t
  misc_feature (846)..(846): n is a, c, g, or t
  misc_feature (855)..(855): n is a, c, g, or t
  misc_feature (898)..(898): n is a, c, g, or t
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaantagggaattccaaactccccccanttaagggcntccctggccataaattgttcttccatgttcccgttataatttnaaacccccttccttaa

SEQ ID NO: 325087 - DNA, 2191 bp, Homo sapiens
gttgtggttggtgtgcgggtttcggttggaggactcgttggggaggtggcctgcgcttgtagagactgcatccccgagacgatggcggagggagataatcgcagcaccaacctgctggctgcagagactgcaagtctggaagaacagctgcaaggatggggagaagtgatgctgatggctgataaagtcctccgatgggaaagagcctggtttccacctgccatcatgggtgtggtttctttggtgtttctgattatctactatctagatccatctgttctgtccggcgtttcctgttttgttatgtttttgtgcttggctgactaccttgttcccattctagcgcctagaatttttggctccaataaatggaccactgaacaacagcaaagattccatgaaatttgcagcaatctagtaaaaactcgacgcagagctgtgggttggtggaaacgcctcttcacactaaaggaagaaaaacctaagatgtacttcatgaccatgatcgtttcccttgctgcggttgcttgggtgggacaacaagtccacaacctgcttctcacctacctgatagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgttcacagcaatattaaataagtgttgttttctcctctttaatattgctgtgaacagtggtgcccattgtagcatatgtttgattttttttcttatgaaataataaaaaactagttctagatcgc

SEQ ID NO: 325088 - DNA, 1259 bp, Homo sapiens
agtcactagcagaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttaaaaaaaaaaaaaaaaaaaaacaaaggggggggggaaaaaatacccggggggcaaattaggggaccggtttttgtaaaggggccaaagggaggaaaaaaaaggagggggggaaaaaggggggga

SEQ ID NO: 325089 - DNA, 750 bp, Homo sapiens
agcactgtgagtcgcatagctgccgtccagagaccattgttcttggacctatggttgatttggtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 325090 - DNA, 681 bp, Homo sapiens
ttaggttgtggaaacaccgctaccctggatttcaaggcaaagtcgtagttgggtgtaactgctgacatcatgatcaggctttgcgcgaggtagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 325091 - DNA, 731 bp, Homo sapiens
ctagaggatcctcggaggagcaatagagatttcgattttgtttcaagttttacctatgtgaaatatgtgtagtggatacacagacagtaagaattgatcgtttggggaagatgcaggatataccaaaagggttctgcttatttatgatggcatccactatgatccacttcagcgtaacttccctgatccagatacacctcctctgaccattttctcctctctgcgtttcaaacgcagagaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 325092 - DNA, 1136 bp, Homo sapiens
agtcactagcagaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 325093 - DNA, 1121 bp, Homo sapiens
  misc_feature (1105)..(1106): n is a, c, g, or t
agtcactagcagaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacgcccnngtagcaggtcagcct

SEQ ID NO: 325094 - DNA, 1082 bp, Homo sapiens
agtcactagcagaaaacaccaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaattta

SEQ ID NO: 325095 - DNA, 271 bp, Homo sapiens
gaaggaaggaaggaaggaaggaaggaaggaaggaaggaaggaagagagggagggaggaaggaaggaggaaggaaggaagagagggagggaggaaggaagagaggaagggagagaggaagaaagggagggaaggataaaggaaagaactagttttaacttcaaaatttattccttgcaaaaaatagacataaccagttaagataattcattttttttttttgagacagaatcttgctctgccgcccaggctggactgcagtggatgtcgacg

SEQ ID NO: 325096 - DNA, 485 bp, Homo sapiens
tgcattttgtccaattctttgttcaaaatgccaagaacctggaggactcatcgtcaaggccctccttcaccagtaacagaaggagaaaaaacaacaatggaatttaccacagcttaaggaccaaatcttcacctgagtttcaagaaccttgtaagcctcaaagattctcattattggaaatcagagtaaaactcgttttcaaataataataatatggtacttcttgctcccaaggtttagggagcaaaaacttgttcattaaatacataaattattcttagtacactgtaaaaggctttctgtctgagtatggcgtgggttttatctgtacatgaaaacaaccttacaacttcagagatttgaaatggacaaactgaagtgttttctcttgtgatcaaaaaaaaaaaaagagtaaaatggcaccattatggtgtatatcaaaaataaaaaaaatttctgtcaacttgtatagaataaattatata

SEQ ID NO: 325097 - DNA, 959 bp, Homo sapiens
ctgaattgtacatcatcttggtgattattccttgtcagtccacagaaagcatcttcactgttttcctcagccgtaatggtagacggagtgactttaagcaaatgtagatataaaggctcatcgtggagaagtttccacagctagggtgatgggtcaagctgaactgatgaacaagaatggagtgggatagaagattctgcatccactggggctcccaaaccatttgcacagatcattttgcccgtggctgggtctggacttcataagaagcttcttctggggtaggtgagagtggatgaccaggactccaccaccctgccgagtcctctcatttccatttggcttccccaggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgaaaaaaaagcac

SEQ ID NO: 325098 - DNA, 456 bp, Homo sapiens
agtaacagtgccgacctgcctgccacttcctgcccctgccagagctgaccagagccctggcctgtctcctctttctcccctgttgcagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgaaaaaaaagcac

SEQ ID NO: 325099 - DNA, 436 bp, Homo sapiens
ctgaattgtacatcatcttggtgattattccttgtcagtccacagaaagcatcttcactgttttcctcagccgtaatggtagacggagtgactttaagcaaatgtagatataaaggctcatcgtggagaagtttccacagctagggtgatgggtcaagctgaactgatgaacaagaatggagtgggatagaagattctgcatccactggggctcccaaaccatttgcacagatcattttgcccgtggctgggtctggacttcataagaagcttcttctggggtaggtgagagtggatgaccaggactccaccaccctgccgagtcctctcatttccatttggcttccccaggtaggacaaccagttcatttgggtttactcccatctttcctaattttagcactggctatgttttatgtggtgaataaagctagcc

SEQ ID NO: 325100 - DNA, 961 bp, Homo sapiens
  misc_feature (50)..(50): n is a, c, g, or t
aggctcccgagtacgccacgtggcgccacgtggacagagcccgtcaactnctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaagtggtggtgatgccgggcagtggagccccctgccagtccagcccacagctgtgggggcccatggccatcttcctcttggcgttgcagagatgatgagagctgtgtggccacccccccaaccttgcccccggcacaccaaagtgtccacattgtaccaaagactgacccccgccagctggggtgcccaggggcagggccggcccgccagggagggggcctgcattggctgcaaggatgagcagagaacaaggacagaggccaggcactgaggccctggagacagctgttccacttgcacacacgcacacactcatgctcacacacacagagatatattaaagcacaagtttctatctgaaaaaaaagcac

SEQ ID NO: 325101 - DNA, 831 bp, Homo sapiens
  misc_feature (50)..(50): n is a, c, g, or t
aggctcccgagtacgccacgtggcgccacgtggacagagcccgtcaactnctccgaacctttcagacaacacctgccactttgaggatgagaagatctgtggctatacccaggacctgacagacaactttgactggacgcggcagaatgccctcacccagaaccccaaacgctcccccaacactggtccccccaccgacataagtggcacccctgagggctactacatgttcatcgagacatcgaggcctcgggagctgggggaccgtgcaaggttagtgagtcccctctacaatgccagcgccaagttctactgtgtctccttcttctaccacatgtacgggaaacacatcggctccctcaacctcctggtgcggtcccggaacaaaggggctctggacacgcacgcctggtctctcagtggcaataagggcaatgtgtggcagcaggcccatgtgcccatcagccccagtgggcccttccagattatttttgagggggttcgaggcccgggctacctgggggatattgccatagatgacgtcacactgaagaagggggagtgtccccggaagcagacggatcccaataaaggtgcaagacgggaaggaggtgggggagctgaatctggagggagctgtgcgtggcgggggttcctgtctgttgagggagggtgtttgggtctgaataggggttcagaatgtctgagtgatgggaatcatgtggctctgactgtgtgaaggtgtgccccacactcactcaggctgtgtacttgtgtaaacaatgagaagcctggcccccaccctcgtgatgagcatactgacctgttcac

SEQ ID NO: 325102 - DNA, 456 bp, Homo sapiens
tatgaaagtaaagttgctgaaatggggctacgtccctgatgcccttgcaggaagaggtatctactgtgcaggctatgtggaggtctaaacactagacagaggatagtgtctcctgctggctggcccaagcctatagctgatgataggtaacatctttttgagtgccacctggagttagtgccaggtaccttgtgattttttcatggattatttcatttaactcttataacatcccagtgatttgctggagccagctgtagtatctctgctcttcgacacaatgctaagatgtgcaaacccacctccagtattggattattttaccagagatcctcaaattggttcacactttgcactatgctttaataacatactaagaaacaaagctgttggttctccccaccctagcccaacactttttagcacatatcattctccccttgcctgttgcccaga

SEQ ID NO: 325103 - DNA, 268 bp, Homo sapiens
taccctgacttcaccactatgcatatatacatctaagaaaatttctcgtgtgccccataaatttgtacaagaaccaatcatataagagacattcagtaaatagttaccaaataaattataagcacacaaatttacaaaaagaactgcagctactgggaggggtgacgtgctagtcccacccacttgggaggctaaggtgggaggatcagttgagcccaggaattcaaggctgaagtgagccatgattgcaccacagcactccagccca

SEQ ID NO: 325104 - DNA, 238 bp, Homo sapiens
gctcactagaatgtcacaacataagggcaggaatttattttctcctgttgtatccccaatacctagaatagtgcctagagtatagcagatactcagcagacatttgctaaatgacttgaattcccaactaatctaaaaatcacacatgcgcgcgcgcgcacacacacacacacacacacacacacacacacacacacaaaatatcacaggaagaggactaccttaggaaaaggattga

SEQ ID NO: 325105 - DNA, 3693 bp, Homo sapiens
gacatcgaggttttgagaggctaactctcccaaaaaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattg

SEQ ID NO: 325106 - DNA, 4101 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattg

SEQ ID NO: 325107 - DNA, 4063 bp, Homo sapiens
tcctcctcctccctttctctctcgatctgtctctcccggcccggaatccattccggcctgggagccggagcggccaggccgccgtctgcccgtcccgctggacgtcccgcggtccgccctcccgtgcgtccgtctgccggtgagcccgcccgcccgccggcccagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattg

SEQ ID NO: 325108 - DNA, 4692 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattgaaaaaaaaaaaaaaaaaaaaaaaaaaaaacaaaaaaaaaaaaaaaaaaacaaaaaaaaaaacaaaacaaaacaaaaaaaacaacaaagaggggggggcaaaaaaaaaaaacacaatgagggcgcacccacacaccacacacaaaaaagaaacaagaggacacaaaaaaagcgcataaaacacacacaacacgaccaaaaaacaaacagctagcgcaaaaacatccgccaaccgggaactctagagaaaaagccaccccctcccgggggggacgacaccatctgacacaacaccccccaagagaataacgccggagagaagacaacacacagagaatctagcgatccacacagacgcagagacaactcgtcagcacgcagaaaagatatcagccacgcaaagtatcagcatagaagaaaatataccgggggagacgcagaacacgaaccaacagcacaacaaaacatacacacagacgcaaccgcccaccaaaaacaccaaagacaacagatagacgacagcgccgacacgcaccactagcaccatgcgacaagagacctcaccgcgcatagtgctaagcaagcaccaacgg

SEQ ID NO: 325109 - DNA, 4652 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattgatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaat

SEQ ID NO: 325110 - DNA, 4418 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattgatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaat

SEQ ID NO: 325111 - DNA, 2169 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaagggtgagtcctgggcggccggggcagggggcaggggcactccggacagggcagggagcatgagcctcatttcctctcatgtctagaatgggcatcttcaaaggtggaatgcagtagagccaaattctctgttgcctgggccggagtgtggtggtgcaatcatagctcacttcagcctcaaccttccaggctcaagcagttctcccacctcagccacccaagtagctgggaccacaggtgtgtgtcaccaggcccagctaattttttattttttgtagagatgggaccctatgttgcccaggctggtctcgaactcttgggctcaaggagtcctcccacttccacctcccaaagtgctgggattacaggtgtgagccacagtaatttttaaactaattagttatttttcaaaattccactttttggaggtatagtttacatatgataaaatacaccccttttaagtgttcagttcagtgggttttaacaactggatttactgtgtacccctaaccataatgaagatatataacatctccatcacccagaaagttcctcatgccctttgcagacagtaccctccagccccaaacccaagcacccactgatttgctttctgtcattataaatttgttttgtttattctagaatttcatacatggaatcttttacatctgggatgca

SEQ ID NO: 325112 - DNA, 989 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggaggtggaggttgaggtgagccaagattgtgccactacactccagcctgggaaacagagcaag

SEQ ID NO: 325113 - DNA, 357 bp, Homo sapiens
gagccccagttttttcctcagctgtcattcctcatggtgcttatctaacagagcggtcatgacaggaggtcagagctgccctgacctttctcgttcctgcaggtgccaaattccccatcaagtggacggctccagaagctgccctctatggccgcttcaccatcaagtcggacgtgtggtccttcgggatcctgctgactgagctcaccacaaagggacgggtgccctaccctggtaagaaggtcctcatggcctgtctgtggtccctgaatccctctgccctggtggccttgggcaagtcatgactcctgctgggcctgtttccccacccgtaaaacaaagaagttgagcgtctga

SEQ ID NO: 325114 - DNA, 391 bp, Homo sapiens
cggccgccgagcccaagctgttcggaggcttcaactcctcggacaccgtcacctccccgcagagggcgggcccgctggccggtcagtgcgcgggcggcgcggggtcctcgcccacctggggccacggcggggaggcggcggggctgtgtgcccggggtcgccccctctgcgcaggcccttcctctcgccaggggtagcgcccctgggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcg

SEQ ID NO: 325115 - DNA, 3298 bp, Homo sapiens
acttccccctcccccctcccttcctctctcctcccttttccctcctttccttgtctccttcttcttcctcttctttcccccagcccccctcctccctgtccccctctctccctgctccacgcagtgtcccactgcccgcctttctctgcagctggctggtatggagggggctgccctgaggagccccagagtaagctggaagggaggggacagaggctggtgtcatttgtctctgtagccctaggaccggtctgaaccggttgctgggagaggaggagggggcggccagatcgattgcagcaaagagggaagagagcggcagagggagctcgcggggcttgcgtgctggaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattg

SEQ ID NO: 325116 - DNA, 3821 bp, Homo sapiens
tcctcctcctccctttctctctcgatctgtctctcccggcccggaatccattccggcctgggagccggagcggccaggccgccgtctgcccgtcccgctggacgtcccgcggtccgccctcccgtgcgtccgtctgccggtgagcccgcccgcccgccggcccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattg

SEQ ID NO: 325117 - DNA, 4281 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtgagtaccgtctctggctgcctctacccgtcgtccctggacactgccggtgcagagtgcctctcctgggctggggtgggaggtctggctgtccagcgccccagccatatccagggagaagcactgtgagtgggcagaagcctggacagtcagcaccatcctccgtcctcccacccccaggtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtccttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaattg

SEQ ID NO: 325118 - DNA, 3287 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcagatcgcctcaggcatggcgtacgtggagcggatgaactacgtccaccgggaccttcgtgcagccaacatcctggtgggagagaacctggtgtgcaaagtggccgactttgggctggctcggctcattgaagacaatgagtacacggcgcggcaaggtgccaaattccccatcaagtggacggctccagaagctgccctctatggccgcttcaccatcaagtcggacgtgtggtccttcgggatcctgctgactgagctcaccacaaagggacgggtgccctaccctgggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagaggctgccgagacagaccctctgccgctgcttccaggctgggcagcacaaggccttgcctggcctgatgatggtgggtgggtgggatgagtaccccctcaaaccctgccctccttagacctgagggacccttcgagatcatcacttccttgcccccatttcacccatggggagacagttgagagcggggatgtgacatgcccaaggccacggagcagttcagagtggaggcgggcttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgggcctggggctccgaaattccaaggcccagacttgcggggggtgggggggtatccagaattggttgtaaatactttgcatattgtctgattaaacacaaacagacctcagaattg

SEQ ID NO: 325119 - DNA, 1674 bp, Homo sapiens
caaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacagaacagagaacagaagctcagagaagtgaagcaacttgcccagctatgagagacagagccaggatttgaaaccagatgaggacgctgaggcccagagagggaaagccacttgcctagggacacacagcggggagaggtggagcagggcctctatttcgagacccctgactccacacctggtgtttgtgccaagaccccaggctgcctcccaggtcctctgggacagcccctgccttctaccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtggagtgaccacctttgtggccctctatgactatgagtctaggacggagacagacctgtccttcaagaaaggcgagcggctccagattgtcaacaacacagagggagactggtggctggcccactcgctcagcacaggacagacaggctacatccccagcaactacgtggcgccctccgactccatccaggctgaggagtggtattttggcaagatcaccagacgggagtcagagcggttactgctcaatgcagagaacccgagagggaccttcctcgtgcgagaaagtgagaccacgaaaggtgcctactgcctctcagtgtctgacttcgacaacgccaagggcctcaacgtgaagcactacaagatccgcaagctggacagcggcggcttctacatcacctcccgcacccagttcaacagcctgcagcagctggtggcctactactccaaacacgccgatggcctgtgccaccgcctcaccaccgtgtgccccacgtccaagccgcagactcagggcctggccaaggatgcctgggagatccctcgggagtcgctgcggctggaggtcaagctgggccagggctgctttggcgaggtgtggatggggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaaggggagtttgctggactttctcaagggggagacaggcaagtacctgcggctgcctcagctggtggacatggctgctcaggtgagtcagcccctcccgcctccccacacccttggtcctcaagcacccagacccatctggtgcagccagttctggcctcttgagtgccccctccaagaagcctgccttg

SEQ ID NO: 325120 - DNA, 119 bp, Homo sapiens
acctctctgtgccctgacttttctatctttaaaatggacgtaacaacagaggtttaataataagaggtttggaggttaagtgctaaaatgcatataaaatacctagcacaggacacagt

SEQ ID NO: 325121 - DNA, 455 bp, Homo sapiens
aatacagttataatcactaacaagcaggaaacactttagggtaaatacaacaaaatatatagaacttgcatgctgaaaactacaaaatgctaacaaaagaagtcaaagaagacctaaataaatggagagatataccatgtttatgaattggaagagctaaaataattaaaatgtcaattctccccacactgatacacagtttatagtagattgagtaaaatctgtgaatatattcaggtcataatccctggaaggagtaaaatctgtgaatatattcaggtcataatccttggaacctctgaatgctatcttatataaaggaactgggctgggcatggtaactcacatctgtaatcccagcactttgggaggccgaggtgggccgatcacctgagatcaggagttcgagatcagactgtccaacatggtgaaaccccgtctctactaaacataca

SEQ ID NO: 325122 - DNA, 442 bp, Homo sapiens
ctggccgtggagcctttctgggttggggagaggaaaggaaagtggaaaaaacctgagaacttcctgatctctctcgctgtgagacatgtctgagactcctgctcagtgtagcattaaggtaaaaatcttctcccctccttctacgtggtggaaaccctgagctgcaccggccagggcagtcgtgctgggctcctcagagcaggctgttgcagttgctctgttcgcaggaaattatttggggcgcgagggaaggagatgcagctcgcggtggctgctgtaccctttagcgtaaccttgctactccccccccaccgccgagcccctgccggctcctcggcccccacccccttgctttttgacaatgaaatgccggtcacaattggtcagagcaacccggattgtctccagaaccgtaaaacacccccgtaattagtgcgcttaa

SEQ ID NO: 325123 - DNA, 884 bp, Homo sapiens
ctggccgtggagcctttctgggttggggagaggaaaggaaagtggaaaaaacctgagaacttcctgatctctctcgctgtgagacatgtctgagactcctgctcagtgtagcattaagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatgcaggaacgaatttcatatacacctccagagagcccagtgccgagttacgcttcctcgacgccacttcatgttccagtgcctcgagcgctcaggatggaggaagactcgatccgcctgcctgcgcacctgcgtgagtgttcgtgacccgagagggacagaggattgatggcgtggggcgggggtggcaggcagtgggctccaggccagagaggggcaagctctgaggtggttttcacaggacttcgccacgctgctttggaatctttcacacccccctacccccaaatacctttgaaaaatttgaggttcctgttccttgtttctcagtgtattcatttcttccctgactatgacatgttaaaaaaaaaagaaacctggaaacatgcagtatatggcagagccaactaaatctcctagtagacaagatgatttctgtgtgtgtgcaaagtttatctgtattctcaaattcacgcttactcaactttaatattttctttggtcctaaattttgctcagtttgtgagtcagactcacttctgctttgtttttaagctgtgcgctcgtcctttctttccagggccctccctcccctccctgtctgtgctggct

SEQ ID NO: 325124 - DNA, 1022 bp, Homo sapiens
aaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggattcagacaga

SEQ ID NO: 325125 - DNA, 650 bp, Homo sapiens
cttatgttctgacccacccaaattactcaattttgaagatataaactttcaagtttcaataacatctctacttctggggaacttctttagcatttcttcatataaaccctgtggatatttagaaggtacctgtctgggaactacatatgtcaaaggggaactgtggtctcaggtttatgcctcttgcgggattaattactgaagtactcaaggccctccttttactgaatcccactgcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaata

SEQ ID NO: 325126 - DNA, 2399 bp, Homo sapiens
aaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatgcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagat

SEQ ID NO: 325127 - DNA, 1075 bp, Homo sapiens
aaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatggtaagtgaaatagtcatctgagctgctgtagtaggttgagcttattgtatcccagatctgagtggttcaactccatgttcatgctgcccagttccaagagcacctctgtggccttcaaacagttgtacacagtctgtaaactgctcagccacttctcccagtcttctaagcaggcaaagactccttatctcttagatctaaaatcattaggtagattttgattccaagggtcaaagcacagcatggtaggcagcaagctctcatccaagcccgtatttcagcaggcaggcgatgctgaggtgctttaggccttcagtgcacacagatagatgcttcccctgagcctcagggaaagctttattttgcccacgttgtattccttcctgcatcgtatatgttaatgttgctctgccactccaaatacagcagtgtctgctcagttccattttcttccttttgcaaagagcaggcaaccagctatgccttcctgagagcagacaaacctggagccaagggggccacattttcagcttcaatagcaattgctgcagctcccttatttcatcacctattaggatgcgcaggcggcgctaagtgacacatagcccataaaacatatctgcttcctgctgatttcatggttctggaggacaggctgtgcacagggattcagacaga

SEQ ID NO: 325128 - DNA, 1102 bp, Homo sapiens
aaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatgcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaata

SEQ ID NO: 325129 - DNA, 808 bp, Homo sapiens
aaaaaaaaaaaaaagatcattcggaaccgaatatgtgaagatcagggctgtgatctggtgaattgggagtgatttatgccacccaagcgagttgacctgaaccgctggggtccatcatcctgcttctgtttctgcactggcatttgtgttagtatttggtggaaggtggttcacttttggctgaagttggtggatgtgggcagagcaggattagttcctttcttctgccctctcttctagcaatgctccaaggatgctttggaagactcattattcagagctgcagctggactgccttagacatctgcatttctctatctctgaaataagggactcaaacaagagcatcactcttttcctttccagctctaaaattatgtgatttttctttcacatgcaggaacgaatttcatatacacctccagagagcccagtgccgagttacgcttcctcgacgccacttcatgttccagtgcctcgagcgctcaggatggaggaagactcgatccgcctgcctgcgcacctgcgttctggggattaggacacggacatttctatttggcagccaacattcagccatctccagtcactgagctacacagaatgaaaagcacctttgaagaatcgtaagccatgaatgatgacgggccgaagggagtgagggctcctacctcttgtcactcctaccatcctgcctccaggacccctgccacctacttgggagtctgcccttaaaactcaagggtcacctgactcattcctccccactcattcatctgactacccaccaaagctaagtgtgaacagc

SEQ ID NO: 325130 - DNA, 2120 bp, Homo sapiens
ctggccgtggagcctttctgggttggggagaggaaaggaaagtggaaaaaacctgagaacttcctgatctctctcgctgtgagacatgtctgagactcctgctcagtgtagcattaagcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagat

SEQ ID NO: 325131 - DNA, 634 bp, Homo sapiens
ctggccgtggagcctttctgggttggggagaggaaaggaaagtggaaaaaacctgagaacttcctgatctctctcgctgtgagacatgtctgagactcctgctcagtgtagcattaagcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagaagcccttcagcggccagtagcatctgactttgagcctcagggtctgagtgaagccgctcgttggaactccaaggaaaaccttctc

SEQ ID NO: 325132 - DNA, 1252 bp, Homo sapiens
aacaaatatggtcgacggtccaaatttggaatgaagggtcccgtggctgtcatcagtggtgaggaggactcagccagcccactgcaccacatcaaccacggcatcaccacgccctcgtcactggatgcggggcccgacactgtggtcattggcatgactcgcatccctgtcattgagaacccccagtacttccgtcagggacacaactgccacaagccggacacgtactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagat

SEQ ID NO: 325133 - DNA, 154 bp, Homo sapiens
gtgcaagtgtgctaggtaccatgatagtgatgaacgtgcggtgctgcaggagcacagaggtcactttgtgctctatcacagaatccctaaaagagtcttaaaaaaggaaacatacatgttcttcatgcagtaattatgcagagtcccattgtag

SEQ ID NO: 325134 - DNA, 444 bp, Homo sapiens
cttccctggtctctggtggggacgcggttctgcagggaaggcaatgcccacccagcctggcacatggggctccgtaaagctggggtgtcaacaacttctggctgtcactgcctgaacaatgttcccccgggccctgcctactgtcttgctgcccgccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325135 - DNA, 1012 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggccggccgtgagtaacccctctggcccgcccgccgccgctctgggccacactgctcagatcctgcgtggctgggccccgagctcagtcttggtgcattcagacagagagtcaccacagagggtcctcgctggcccccaacttcagaagaactggggagttaaggattaaatgagtcaaagtattaactgctttta

SEQ ID NO: 325136 - DNA, 314 bp, Homo sapiens
  misc_feature (16)..(16): n is a, c, g, or t
  misc_feature (21)..(21): n is a, c, g, or t
  misc_feature (36)..(36): n is a, c, g, or t
  misc_feature (38)..(38): n is a, c, g, or t
  misc_feature (65)..(65): n is a, c, g, or t
  misc_feature (88)..(89): n is a, c, g, or t
  misc_feature (106)..(106): n is a, c, g, or t
  misc_feature (127)..(127): n is a, c, g, or t
  misc_feature (133)..(134): n is a, c, g, or t
  misc_feature (181)..(181): n is a, c, g, or t
  misc_feature (185)..(185): n is a, c, g, or t
  misc_feature (188)..(188): n is a, c, g, or t
aatttaaagtgccctnaaaanattaatgtttatctnantattatgtaatatggaaattaaaaggnaaaaaaatccaaagacttactgnnaaaatataattgaagtnttttatatgatgaagtgctcnataaannaaatgtaaaaaaccaatagaaaatatatgaaataaaataaaattatncgtnaanggcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325137 - DNA, 3462 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggccgtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325138 - DNA, 3429 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggtgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325139 - DNA, 2803 bp, Homo sapiens
gagcaccgccgcctgccacactgtgagacagggaagggagtctgagggtcttggttttctgccctcaccactgtcaggtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325140 - DNA, 1952 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccggggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325141 - DNA, 1714 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacgccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325142 - DNA, 1706 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325143 - DNA, 1102 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggccggccgtgagtaacccctctggcccgcccgccgccgctctgggccacactgctcagatcctgcgtggctgggccccgagctcagtcttggtgcattcagacagagagtcaccacagagggtcctcgctggcccccaacttcagaagaactggggagttaaggattaaatgagtcaaagtattaactgctttta

SEQ ID NO: 325144 - DNA, 450 bp, Homo sapiens
gtcaggtgttgcacctggagggcccagatggatcaatgaggcatttaaagtgtagaatctcaccctgaacccagactattcaggtccgtttttctaggaaagttatttctttttcacttttagattcaagtgctcattttcttcttcaaatttagagcacttcagtatgaacaatatttcttttgttaaaaaatatttcttggaaacaacttattgaagtttcctcagagtggccaaagccgatgataattttattccagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcc

SEQ ID NO: 325145 - DNA, 3519 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325146 - DNA, 3571 bp, Homo sapiens
gtagaggcatgttttgcaatctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325147 - DNA, 2680 bp, Homo sapiens
gctactgagacagagaactcacatgggtgcccacccaagcgggtctgtgacagagagaatgacgcctgcagtgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325148 - DNA, 2288 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325149 - DNA, 2172 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaactttggacacgcacttttgagttaatgctggaataagttaagactttcagtctgttgggaaggcatgattggttttgaaatgtgagaagaaggacatgacacttgggaggggccagaggagaaatcatatggcttggccctctgtccccacccaaatctcatctcaaattgtaatcccctcatgtcagacgacggca

SEQ ID NO: 325150 - DNA, 1056 bp, Homo sapiens
attgatattcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggccttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325151 - DNA, 875 bp, Homo sapiens
gctactgagacagagaactcacatgggtgcccacccaagcgggtctgtgacagagagaatgacgcctgcagtgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacgccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagaa

SEQ ID NO: 325152 - DNA, 532 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325153 - DNA, 518 bp, Homo sapiens
gcgtgccgctactactactaaattcgcggccgcgtcgacatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325154 - DNA, 505 bp, Homo sapiens
cggacgcgtgggtcgacccacgcgtccgcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325155 - DNA, 790 bp, Homo sapiens
gcgtgccgctactactactaaattcgcggccgcgtcgacatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaacaaacaaaaacaaaaaaaaaaaaaaaagaaaaaaaaaaaaaggggggggagggcagcaaaaaagataatccacccaacgagggccccaagtcaagaaggccagcaccagtcattcgagacaacagggcgcccatagaagcggcagataacaacgccaagcgactagcgccgcatctacaaccaggagcgtaaagcaggaaacagcgcgcgcacgctactatgtgcaacgccaccacccggaggagcaacactgggcacaacccaggagcaac

SEQ ID NO: 325156 - DNA, 779 bp, Homo sapiens
  misc_feature (596)..(596): n is a, c, g, or t
  misc_feature (600)..(600): n is a, c, g, or t
  misc_feature (602)..(602): n is a, c, g, or t
cggacgcgtgggtcgacccacgcgtccgcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaaaaaaaaaaaaaaaaaaaaaacaaaacaaaaaaaaaaaaaaaaaaaaaaaaaaaaggggggggggccccaaaaancccncngggggggccacaaagacgcgccccccgcgtctgacggagcaaaaggggcggccaacagacgggcgccgcgcaaacacagacacggcggcggcggcggccggacaacacaaaggccggcgagggaggacaaccgacgagcgggcggaacccggaaagaacaccccccccggcgggaga

SEQ ID NO: 325157 - DNA, 786 bp, Homo sapiens
tacggctaggtacgaggctgggtggtggtggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaataaaaaacaaacaaaaacaaaaaaaaaaaaaaaagaaaaaaaaaaaaaggggggggagggcagcaaaaaagataatccacccaacgagggccccaagtcaagaaggccagcaccagtcattcgagacaacagggcgcccatagaagcggcagataacaacgccaagcgactagcgccgcatctacaaccaggagcgtaaagcaggaaacagcgcgcgcacgctactatgtgcaacgccaccacccggaggagcaacactgggcacaacccaggagcaac

SEQ ID NO: 325158 - DNA, 468 bp, Homo sapiens
ggaggctgcagtgagctaagatcataccactgcacttcaggcctgggcgtcagagtgagaccctgtttctaaaataataataattttaaaaaatgatatttatggttgcattgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325159 - DNA, 355 bp, Homo sapiens
gcggccgcctactactactactactaattacgcgcgctcgacagaaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325160 - DNA, 512 bp, Homo sapiens
  misc_feature (1)..(1): n is a, c, g, or t
  misc_feature (62)..(64): n is a, c, g, or t
  misc_feature (69)..(69): n is a, c, g, or t
  misc_feature (71)..(71): n is a, c, g, or t
  misc_feature (82)..(82): n is a, c, g, or t
nattttaggtgaacactatgagacacaagttatgtaacaaaaaaagacaggtctggtacccnnncccgnancccccgcgccnccgcccccccttagccccctcctcttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325161 - DNA, 681 bp, Homo sapiens
  misc_feature (498)..(498): n is a, c, g, or t
  misc_feature (502)..(502): n is a, c, g, or t
  misc_feature (504)..(504): n is a, c, g, or t
gcgtgccgctactactactaaattcgcggccgcgtcgaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaacaaaaaaaaaaaaaaaaaaaaaaaaaaaaggggggggggccccaaaaancccncngggggggccacaaagacgcgccccccgcgtctgacggagcaaaaggggcggccaacagacgggcgccgcgcaaacacagacacggcggcggcggcggccggacaacacaaaggccggcgagggaggacaaccgacgagcgggcggaacccggaaagaacaccccccccggcgggaga

SEQ ID NO: 325162 - DNA, 314 bp, Homo sapiens
acagcagcgcgtgctgtccggacagcacgcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325163 - DNA, 313 bp, Homo sapiens
ccggccgcggaccggctgcgagagacgacagaaggggctctcgttccccggcgaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325164 - DNA, 299 bp, Homo sapiens
  misc_feature (17)..(17): n is a, c, g, or t
gtgtcgtcacggatccntagatacacgcattatagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtgaaatagagtactatgctataatggcgttatcacgggatcctctagacaacc

SEQ ID NO: 325165 - DNA, 188 bp, Homo sapiens
gcggccgcctactactactactactgctcgaattcaagcttctaacgatgtacggggagtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325166 - DNA, 233 bp, Homo sapiens
gcggccgcctactactactactactgctcgaattcaagcttctaacgatgtacggggacatggtgaaaccccgtctctaataaaaatacaaaaattagccggggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325167 - DNA, 1049 bp, Homo sapiens
ccggctctgccgtgaagagctttgcattgtgggaagtctttcctttctcgttccccggccatcttagcggctgctgttggttgggggccgtcccgctcctaaggcaggaagatggtggccgcaaagaagacggtgagtgaggcgggccaggcccggaagacgattcacgtggagagatgtcttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggtagcgattgtggtgtttggcccttcattcccgtctccccgacccacccccaaatcgtgtgctccccttctgtgagcttatttttggaggagaaatgtgtgtgtgtggcaggagtgaaaacagaacatcgaggtttaatggaaacacagacacattactgttttttccatgtattttgtgtcctgcttttttggttcttttagctttgaggtgctttaatgatgcttcattgtgtgaacttgttttagtgtcaaaaaactaggtaagaaaagttgaggctgggctatggagttgcaggctatcatagaatcacctagtttagcccgctaaatcagttctgagtcaagatttatgcttgactcactgttttgaaattgaacttagggggtgttgta

SEQ ID NO: 325168 - DNA, 849 bp, Homo sapiens
gtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttctttcttttttatttttttgtagagacaggggtggtctatgttgtccaggctggccttgagctggacgcaacagatcttcccgcctcaacctccgaaagtgctgggattaaaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325169 - DNA, 539 bp, Homo sapiens
ccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325170 - DNA, 765 bp, Homo sapiens
ccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaagaaaaaaatgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgccgttcttacaccggtttcaac

SEQ ID NO: 325171 - DNA, 801 bp, Homo sapiens
ccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaacttcggaggttgtgtattattatgaagggcgagggggggagggagaaagggggctttcaataagcccgggggtttccccgcgcgtacggggacaccagggcatcggaatcggtagaacaaagggtgtacgaagtggcgagggacacaccacagtccggaacaccagaacacaaggtcgggggggccccatataagacaattccacacgcgggagtgcgggtcgcataagccggaaaggtccggtaa

SEQ ID NO: 325172 - DNA, 482 bp, Homo sapiens
ccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325173 - DNA, 1260 bp, Homo sapiens
aagcttcgacggccgccagtgtgctctaaagggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgaaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggaactccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaacgacctgaaaaaaaaatttttttttttttttttttttttttttttaaagttttcagacttatttcacagcgattgacacagaaacataccgtgactctgacatcattagaagcatgccagaacagactggtgaaaagtaaacgtttactttagagcattttttttttttttttttttttaaagttttcagacttatttcacagcgattg

SEQ ID NO: 325174 - DNA, 345 bp, Homo sapiens
gtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttctttcttttttatttttttgtagagacaggggtggtctatgttgtccaggctggccttgagctggacgcaacagatcttcccgcctcaacctccgaaagtgctgggattaaaggtatgagcagccgcgtacggcccccgcagccattctagccagcggtaccaatagcaaccggcagctgccctc

SEQ ID NO: 325175 - DNA, 815 bp, Homo sapiens
  misc_feature (750)..(751): n is a, c, g, or t
  misc_feature (754)..(754): n is a, c, g, or t
  misc_feature (762)..(762): n is a, c, g, or t
gtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttctttcttttttatttttttgtagagacaggggtggtctatgttgtccaggctggccttgagctggacgcaacagatcttcccgcctcaacctccgaaagtgctgggattaaaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaannaanaaaaaaanaaaaaaaaaaaaaacaacaaaaaaacacacacaaaaacaaaaacaaaaaaaaa

SEQ ID NO: 325176 - DNA, 776 bp, Homo sapiens
ccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaaaaaaacaaacaaaaacaaaaaaaaaaaaaaaagaaaaaaaaaaaaaggggggggagggcagcaaaaaagataatccacccaacgagggccccaagtcaagaaggccagcaccagtcattcgagacaacagggcgcccatagaagcggcagataacaacgccaagcgactagcgccgcatctacaaccaggagcgtaaagcaggaaacagcgcgcgcacgctactatgtgcaacgccaccacccggaggagcaacactgggcacaacccaggagcaac

SEQ ID NO: 325177 - DNA, 536 bp, Homo sapiens
gtgaaagtaaccttcacctacaaattcacctgcatgccccagggttcccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgtgttgatctcttctgacatcattagaagcattgcccctaggggaaaaaaaaccaaaagggggaaaaaaacctttttttgggggggggggggctttttgggggggggaaaaaaacacacacccacccaccac

SEQ ID NO: 325178 - DNA, 529 bp, Homo sapiens
taggtgatctagaggatccggtcattgctacacgcttctcgtccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325179 - DNA, 836 bp, Homo sapiens
atttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagttttttttgtcctttttgttattttgcaaaagaaaatagtatttacaggtggcatcgataaacaccggtgtttatcgatgccaccatgttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325180 - DNA, 517 bp, Homo sapiens
atgtatgtctgtgttcagtgttacccgaggatcacgccattatagcggctgctgtaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325181 - DNA, 507 bp, Homo sapiens
  misc_feature (17)..(17): n is a, c, g, or t
gtgtcgtcacggatccntagatacacgcattatagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325182 - DNA, 490 bp, Homo sapiens
tacggctaggtacgaggctgggtggtggtggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325183 - DNA, 1695 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaacctcgagactagttctctctctctctctctccccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggaaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttg

SEQ ID NO: 325184 - DNA, 599 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaacattgtatctatttcagtatttttctctatttttgtttcaatacaatttcctgaaggttggattag

SEQ ID NO: 325185 - DNA, 804 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaacaaacaaaaacaaaaaaaaaaaaaaaagaaaaaaaaaaaaaggggggggagggcagcaaaaaagataatccacccaacgagggccccaagtcaagaaggccagcaccagtcattcgagacaacagggcgcccatagaagcggcagataacaacgccaagcgactagcgccgcatctacaaccaggagcgtaaagcaggaaacagcgcgcgcacgctactatgtgcaacgccaccacccggaggagcaacactgggcacaacccaggagcaac

SEQ ID NO: 325186 - DNA, 806 bp, Homo sapiens
  misc_feature (623)..(623): n is a, c, g, or t
  misc_feature (627)..(627): n is a, c, g, or t
  misc_feature (629)..(629): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaaaaaaaaaaaaaaaaaaaaaacaaaacaaaaaaaaaaaaaaaaaaaaaaaaaaaaggggggggggccccaaaaancccncngggggggccacaaagacgcgccccccgcgtctgacggagcaaaaggggcggccaacagacgggcgccgcgcaaacacagacacggcggcggcggcggccggacaacacaaaggccggcgagggaggacaaccgacgagcgggcggaacccggaaagaacaccccccccggcgggaga

SEQ ID NO: 325187 - DNA, 768 bp, Homo sapiens
  misc_feature (585)..(585): n is a, c, g, or t
  misc_feature (589)..(589): n is a, c, g, or t
  misc_feature (591)..(591): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaacaaaaaaaaaaaaaaaaaaaaaaaaaaaaggggggggggccccaaaaancccncngggggggccacaaagacgcgccccccgcgtctgacggagcaaaaggggcggccaacagacgggcgccgcgcaaacacagacacggcggcggcggcggccggacaacacaaaggccggcgagggaggacaaccgacgagcgggcggaacccggaaagaacaccccccccggcgggaga

SEQ ID NO: 325188 - DNA, 833 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaagttccacaaaagaaaaacaataaaaactaaacaacttttttggcgccgccttgcgacccctcaagaagaggtttcgagaaccccttcgtctgggacacgcggggcccccatagaggataaggagaacagtgcgcaaaagctgtccccgagagaaaacccgggctccaggactgagtggcgggatttctcaccaattaaaaaaagcccggggggaaacgccaacggttctgaacaatccaaaaggagctcgggacaagaggaattcaacaggagtcacagggggcgatatatagcgggcgg

SEQ ID NO: 325189 - DNA, 562 bp, Homo sapiens
  misc_feature (543)..(543): n is a, c, g, or t
  misc_feature (547)..(547): n is a, c, g, or t
  misc_feature (550)..(550): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaggaaaaaaaanaaanaanaaaaaaaaaaaa

SEQ ID NO: 325190 - DNA, 639 bp, Homo sapiens
  misc_feature (574)..(575): n is a, c, g, or t
  misc_feature (578)..(578): n is a, c, g, or t
  misc_feature (586)..(586): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaccaaaaaaaaaaaaaaaaaaaaaaaaaaaaaaaaaaaaaaannaanaaaaaaanaaaaaaaaaaaaaacaacaaaaaaacacacacaaaaacaaaaacaaaaaaaaa

SEQ ID NO: 325191 - DNA, 828 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaataaaaaacaaacaaaaacaaaaaaaaaaaaaaaagaaaaaaaaaaaaaggggggggagggcagcaaaaaagataatccacccaacgagggccccaagtcaagaaggccagcaccagtcattcgagacaacagggcgcccatagaagcggcagataacaacgccaagcgactagcgccgcatctacaaccaggagcgtaaagcaggaaacagcgcgcgcacgctactatgtgcaacgccaccacccggaggagcaacactgggcacaacccaggagcaac

SEQ ID NO: 325192 - DNA, 712 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaggacagcacgcgctaagcaagctaatttttgtatttctagtagagatgaggtttcaccatgttggccaggctggtcttgaactcctgacctcaagtgatccacctaccacagcctcctaaagtactgggattacaagcatgagtcactacacccgacctcatagtagttttgatttacacttccctaatgatggtgtccagcatctactggccatttgttagcgcgtgct

SEQ ID NO: 325193 - DNA, 532 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaacctcctccatgttaattcccctatcccccatttatcctcgtatccctctcccctgacatcatttgcgggttataatctc

SEQ ID NO: 325194 - DNA, 792 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacggtgagtgaggcgggccaggcccggaagacgattcacgtggagagatgtcttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325195 - DNA, 445 bp, Homo sapiens
gcgtgccgctactactactaaattcgcggccgcgtcgaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325196 - DNA, 507 bp, Homo sapiens
gcgtcgacgccttaggagcgggacggcccccaaccaacagcagccgctaagatggccggggaacgagaaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325197 - DNA, 1327 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtatgctttttaaatcataaagtcttttttttttttgcctttctaatgtaatgtctggacaagtatttcttactacgcaaatgtctttggttcctaaattcagatagaatatggatctagcaaggcatatcgtgtagttgtattttgtagagaattggtaatgaatgccaatacattataattggctttattataagttaaaatttttactgtcagataatgaatttcatttgatgaagtacctatgaaataatgacatagatttggtaaaaggtgaaattataaggagagaataatctggcaaaacagaagaaagtaattcttgcttcttgagaacagacatgtaaaattagcttgagaaaaaaaaaagtgccaaaaaatctacatcattctgttttccaattgtgaatctttgattcatagaatactgcgaatattctcgctgttctgattttgtaatagtcaggacaggctaaacattcgctatattaagaccatgcatgtgtccccaaacctagttctttccctaggtctggttttataaatgctggtgataaaccaattttattatatgatcattttatgtgattatataatggctgtgattctaggttatctttggtcaaccttaagaaaaatgacagtacagctaatgtgataacttttgcaaaaagtcagtgctaatttgcagaccattgtctacagaagggataaccaaaggtagagaaattttatggtaccagttgctattaaatgaattgtaaaattactgtttttttatttttattttttagggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325198 - DNA, 587 bp, Homo sapiens
  misc_feature (522)..(523): n is a, c, g, or t
  misc_feature (526)..(526): n is a, c, g, or t
  misc_feature (534)..(534): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccagcttttcacctacaaaatttcacctgcaaaccttaaacctgcaaaattttcctttaataaaatttgcttgttttaaaaaccaaaaaaaaaaaaaaaaaaaaaaaaaaaaaaaaaaaaaaannaanaaaaaaanaaaaaaaaaaaaaacaacaaaaaaacacacacaaaaacaaaaacaaaaaaaaa

SEQ ID NO: 325199 - DNA, 645 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactggcatcagacctcaaacctacatataacacagtgttgctaacaatcagcaacatcactgccattacggatcggtgtgggtacagtcgcgctcaacactcactctcatgtatgtatcactctctgcgattcattcggggcacatagataatcaacgacaactgatctatacatcacgtctcagtgaagtgctctaatcataatgcagaggccagacatagggcacactccgtcgttacactccgtaccatactcgaaacatatctattcaatctccacatatacccatacaccacagagc

SEQ ID NO: 325200 - DNA, 472 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagccatgagatgttggaagcttccaacatctcatcgcgccttccaacatctcactgcaagctctgcctcccgggttcacgccatgagatgttggaaggccttccaacatctcatggcgtgatgagatgttggaaggggtaccgagc

SEQ ID NO: 325201 - DNA, 648 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325202 - DNA, 908 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacggtgagtgaggcgggccaggcccggaagacgattcacgtggagagatgtcttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325203 - DNA, 607 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 325204 - DNA, 749 bp, Homo sapiens
  misc_feature (566)..(566): n is a, c, g, or t
  misc_feature (570)..(570): n is a, c, g, or t
  misc_feature (572)..(572): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaaaaaaaaaaaaaaaaaaaaaacaaaacaaaaaaaaaaaaaaaaaaaaaaaaaaaaggggggggggccccaaaaancccncngggggggccacaaagacgcgccccccgcgtctgacggagcaaaaggggcggccaacagacgggcgccgcgcaaacacagacacggcggcggcggcggccggacaacacaaaggccggcgagggaggacaaccgacgagcgggcggaacccggaaagaacaccccccccggcgggaga

SEQ ID NO: 325205 - DNA, 786 bp, Homo sapiens
  misc_feature (1)..(1): n is a, c, g, or t
  misc_feature (62)..(64): n is a, c, g, or t
  misc_feature (69)..(69): n is a, c, g, or t
  misc_feature (71)..(71): n is a, c, g, or t
  misc_feature (82)..(82): n is a, c, g, or t
  misc_feature (603)..(603): n is a, c, g, or t
  misc_feature (607)..(607): n is a, c, g, or t
  misc_feature (609)..(609): n is a, c, g, or t
nattttaggtgaacactatgagacacaagttatgtaacaaaaaaagacaggtctggtacccnnncccgnancccccgcgccnccgcccccccttagccccctcctcttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaaaaaaaaaaaaaaaaaaaaaacaaaacaaaaaaaaaaaaaaaaaaaaaaaaaaaaggggggggggccccaaaaancccncngggggggccacaaagacgcgccccccgcgtctgacggagcaaaaggggcggccaacagacgggcgccgcgcaaacacagacacggcggcggcggcggccggacaacacaaaggccggcgagggaggacaaccgacgagcgggcggaacccggaaagaacaccccccccggcgggaga

SEQ ID NO: 325206 - DNA, 744 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaagtaggtgaaaaggtttacttttcaccagtctgcacagcatgcggaaaatactacagagtgtgcacacgtggctatcattgatccaggtgactctgacgatcattagaagcgatgccagaacagactggtgaaaagtaagaccttttcacctagcaaaatttcagctggcaaaccgttaaacctgggaaaagtttcccgtgtagataaaatttgctagctgtgaaagatgaacaggaagataagaaaacagagacgcataacgagaaagaaagaatgagaagggagatgtatggagaggagggaagaaggggaggagaga

SEQ ID NO: 325207 - DNA, 782 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggtagcgattgtggtgtttggcccttcattcccgtctccccgacccacccccaaatcgtgtgctccccttctgtgagcttatttttggaggagaaatgtgtgtgtgtggcaggagtgaaaacagaacatcgaggtttaatggaaacacagacacattactgttttttccatgtattttgtgtcctgcttttttggttcttttagctttgaggtgctttaatgatgcttcattgtgtgaacttgttttagtgtcaaaaaactaggtaagaaaagttgaggctgggctatggagttgcaggctatcatagaatcacctagtttagcccgctaaatcagttctgagtcaagatttatgcttgactcactgttttgaaattgaacttagggggtgttgta

SEQ ID NO: 325208 - DNA, 1042 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacggtgagtgaggcgggccaggcccggaagacgattcacgtggagagatgtcttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggtagcgattgtggtgtttggcccttcattcccgtctccccgacccacccccaaatcgtgtgctccccttctgtgagcttatttttggaggagaaatgtgtgtgtgtggcaggagtgaaaacagaacatcgaggtttaatggaaacacagacacattactgttttttccatgtattttgtgtcctgcttttttggttcttttagctttgaggtgctttaatgatgcttcattgtgtgaacttgttttagtgtcaaaaaactaggtaagaaaagttgaggctgggctatggagttgcaggctatcatagaatcacctagtttagcccgctaaatcagttctgagtcaagatttatgcttgactcactgttttgaaattgaacttagggggtgttgta

SEQ ID NO: 325209 - DNA, 884 bp, Homo sapiens
  misc_feature (548)..(548): n is a, c, g, or t
  misc_feature (550)..(550): n is a, c, g, or t
  misc_feature (625)..(625): n is a, c, g, or t
  misc_feature (634)..(634): n is a, c, g, or t
  misc_feature (656)..(656): n is a, c, g, or t
  misc_feature (777)..(777): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaagggangnccccaggccttgctaagcatgcgtggtatcaagaggtgcattgaggcgctcctgcagctcctcccggcacgggantcctcaaanccccagcctcagttccctgacnggcacggggctcactcttccccattccggggccaggaacgccagcctgtttgcctttggtcccaattggggtgctcttccttcgcgaactgttccccaggtgggcaccaagctccgccttncggttgttgcccgggcccaggaggctgcgggaagaagtgcacgctgccaagcttcaacttgaattgcccccagtatttgcgagcccagaccactgagtgtgagggcc

SEQ ID NO: 325210 - DNA, 723 bp, Homo sapiens
  misc_feature (614)..(614): n is a, c, g, or t
gcgtgccgctactactactaaattcgcggccgcgtcgaaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaaccgcggaggccttctagtgcgcgggggcgcggaaaaagcgaggtacgtgacaggggcccctgtggcctatgagcctgttcctcggacccagttttccttgttcccaaggggggatagaaccggcccggtatccccctataatggggaggccgntattaaattccgaaataagcccgagttttacccgggctttagacactcctgggcacaaaaggacacacgacacacaaagacaaaaacacccacccaacaaacacgggta

SEQ ID NO: 325211 - DNA, 902 bp, Homo sapiens
actgcatccaacgccgccagggtcacgggcggctgggacaacctccttgctgtgatccctggcggctcgtctacgccactgatccccaagtctgtgtgtgagacggtgctgatggacttcgatgcgctggtgcaggcacagacaggcctgggcacagctgcggcgttggatgcagtcgactgcatccaacgcgttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgtgcttcgcctaccgcgaattcatcgtgaacgaatatacaggagtgtaaacttgtaatctgagtaccatgaactcgaacacttgcaggataattacggtagcgattgtggtgtttggcccttcattcccgtctccccgacccacccccaaatcgtgtgctccccttctgtgagcttatttttggaggagaaatgtgtgtgtgtggcaggagtgaaaacagaacatcgaggtttaatggaaacacagacacattactgttttttccatgtattttgtgtcctgcttttttggttcttttagctttgaggtgctttaatgatgcttcattgtgtgaacttgttttagtgtcaaaaaactaggtaagaaaagttgaggctgggctatggagttgcaggctatcatagaatcacctagtttagcccgctaaatcagttctgagtcaagatttatgcttgactcactgttttgaaattgaacttagggggtgttgta

SEQ ID NO: 325212 - DNA, 821 bp, Homo sapiens
  misc_feature (769)..(769): n is a, c, g, or t
  misc_feature (771)..(771): n is a, c, g, or t
  misc_feature (775)..(775): n is a, c, g, or t
  misc_feature (784)..(784): n is a, c, g, or t
  misc_feature (802)..(802): n is a, c, g, or t
  misc_feature (805)..(805): n is a, c, g, or t
  misc_feature (810)..(810): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaacctcgagactagttctctctctctctctctccccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctagggtttgggaccccagcctngncccngttacctgngggtctctttgcactagngtncgccnccagtgggagc

SEQ ID NO: 325213 - DNA, 892 bp, Homo sapiens
  misc_feature (755)..(755): n is a, c, g, or t
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaaaaaaacgggcgccgggcatgggcgccgccgccggcggtccccgaccggatccggagcggtgcccctgaggcctccgtgctggggtccgaggaagccggccatgaatgaccggagcagtcggaggcggacaatgaaggacgatgagacttcgagatctccattcctcgatgaggccccactaacccacgatcttttcgctgagccctctgganaaattcgagacctcggaggctggtctcgccctggtctgatgaaaggtcagaccagtgcctggtcgggagaatctgtgagagcgctcgaggaccgggaaaaggatccgggtgcgtgacaatctcttcgtcggatgaga

SEQ ID NO: 325214 - DNA, 758 bp, Homo sapiens
ccggccgcggaccggctgcgagagacgacagaaggggctctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaagaaaaaaatgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgccgttcttacaccggtttcaac

SEQ ID NO: 325215 - DNA, 857 bp, Homo sapiens
  misc_feature (521)..(521): n is a, c, g, or t
  misc_feature (523)..(523): n is a, c, g, or t
  misc_feature (598)..(598): n is a, c, g, or t
  misc_feature (607)..(607): n is a, c, g, or t
  misc_feature (629)..(629): n is a, c, g, or t
  misc_feature (750)..(750): n is a, c, g, or t
cggacgcgtgggtcgacccacgcgtccgcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaaaaaaaaaaaaagggangnccccaggccttgctaagcatgcgtggtatcaagaggtgcattgaggcgctcctgcagctcctcccggcacgggantcctcaaanccccagcctcagttccctgacnggcacggggctcactcttccccattccggggccaggaacgccagcctgtttgcctttggtcccaattggggtgctcttccttcgcgaactgttccccaggtgggcaccaagctccgccttncggttgttgcccgggcccaggaggctgcgggaagaagtgcacgctgccaagcttcaacttgaattgcccccagtatttgcgagcccagaccactgagtgtgagggcc

SEQ ID NO: 325216 - DNA, 281 bp, Homo sapiens
tggcaagtttatctattatgaagtcctctccttcaactattctagctagctttctagtaccacattaaagttctttaccttttatctgtaatatgaagtagacataattgttttattttttgagacagagtcacactccgtcatccaggttggagtgcagtggcatgatcttggctcactaatatatactagtatacattattttaaatgatggatgttttaatagtattcattgttcttaatatgtgcaagccttggtgtttcaggaaaataggtaattt

SEQ ID NO: 325217 - DNA, 2261 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325218 - DNA, 2551 bp, Homo sapiens
ctcccgctcgggaccgtccacttcctcagtcctccggccgcggcttgggcagggtcagggctgggaagtgttgcaaaaacttaactgccctcggaacttgcacgcgccgtgaactgggcggtgttcctaaagggcttcggtttgctggttttgttttggtcctgtcttgcaaatgagcataaagttgtttctcccccagcctcctcccctttcctttctgataggggccagcggcgaaggggcttctaaggggaagcgcctggactgggcatcgccgtcccggttctcgccgcctgtgggagtgtgaggttaaccgtgctcggtgcagggttgcggggcgcggagcttgctgcgtccacactgcttgtgtgagcagtgtcctctctgtgctcatttccaacgagaaacgttggaactttggtgttcttatcagctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325219 - DNA, 2100 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325220 - DNA, 2243 bp, Homo sapiens
  misc_feature (2)..(2): n is a, c, g, or t
anattcggcatgaggtaccaatctgaagtgggaggcggcgggactggtccctctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgaggaatgtttcaaaatcattggcatatgacaagaaaaagtatacagcaaacaaaaaagtagaaggtattctagagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325221 - DNA, 2120 bp, Homo sapiens
  misc_feature (2)..(2): n is a, c, g, or t
anattcggcatgaggtaccaatctgaagtgggaggcggcgggactggtccctctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataaatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325222 - DNA, 1614 bp, Homo sapiens
cgaatcgagtcggtaccaagttcgggccggggcatgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325223 - DNA, 2003 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatgccctcccacttttatcagtttagtagtagtactgagaaaaatcccttcagctctaagaacactgaaa

SEQ ID NO: 325224 - DNA, 2235 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcagcggaggcgttggcaagtcagccctgacgcttcagttcatgtatgacgagtttgtagaagactatgaacctaccaaagctgacagttatagaaagaaagtggttcttgatggggaagaagttcagatagatattctggacaccgctgggcaagaggactacgcagccattcgagataactactttcggagtggggaagggtttcttcttgtgttctcaatcacagaacatgaatcctttacagcaactgccgaattcagggaacagattctccgtgtgaaggctgaagaagataaaattccactgctcgtcgtgggaaacaagtctgacctagaggagcggaggcaggtgcctgtggaggaggccaggagtaaagccgaagagtggggcgtgcagtacgtggagacgtcagcgaagacccgggccaacgtggacaaggtgttctttgacctaatgagagaaatcagaacaaagaagatgtcagaaaacaaagacaagaatggcaagaaaagcagcaagaacaagaaaagttttaaagaaagatgttgcttactatgagtgtcaaggtgacggatgaagccagctgctcctaaggacacagggctgggttggtaaagagaaggctatggttgacttcttgcttgtgcttcccactctccccgacttcattcactcaaacttctttaaatggggaaaaatatttgtgactcagtggctggcagaagaaataagcccatgcaagtggaagggctgctttgtcaggaggttgtggaatttctttcttctccccttcttccctcccaaaagcttagctatgtataaagtgccacagataggaaacagctgttaattacaaagagaaagaattgtcatagcatcttattttgttcctagttttataacattaccatccttcgttttgaactacagatgttgtagtgggttttggaggagggagtggagtaagatgccctcccacttttatcagtttagtagtagtactgagaaaaatcccttcagctctaagaacactgaaaaatccaccgattttttgggtaagcttcttggcaataccctgtggatctgaaacagctaaaaaaatgaatttgaattgcgccagataggtcaataccaagcttctgattcctcctcacatatgaaaagtgaaagttgtgagttgttttcctcttatttaaacattggcctattataatctgtgttggttatttttctcctgtaagcatcctgatttttctgtaggaacttttctttggcagaccaagtgaagactcaggaatggtgtgcattataaatgacacacattgccacttgtgtagatatttttaagttctttggctaagtcctctcctaactgcctgtcctctggttaggcccctccctctccactagtggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccccaagctagccactatcatctgacctgcaacaactctagctcccccacaaacaaccccgcccttccttttcaaccacaaccccgccttctcccccgccacccctctcccacctctcttgacccct

SEQ ID NO: 325225 - DNA, 834 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgaatgcatgtgtctgtctgatcagcatcactgcacacggaggtctagtgagcctcttgctaagtgtcacacacactcttcccaaagacgtgatgagttaaagttgtattctgaaatcatgaagccagagcctgtgccagaccttctgctacctctcatagaattgctctgtaattctaaatttaaaattagaagtagagagagataagccatcgcccctttgcctctgagaattggctgctgtttctaatataattattttctaagatagccagatagttagaaaaagattttcattgatgacatatctttaaactttcttgcatcagtattctaaattgagcaaactgaaagattttcatcaggaaaggagcactgtgggaagagcccagtattcacattttttccccatttttcagaagcgacatttcatatataggtgccaaaagtgaatcggggtgcggagagtgggaaccttttgaatttatgattgtcacagagatggtagaaattatgatctgactggaaaacaatcctgtatcccctcccaaagaatcatgggctttttttttgaattaaaaagcagacaaataga

SEQ ID NO: 325226 - DNA, 2895 bp, Homo sapiens
cagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatg

SEQ ID NO: 325227 - DNA, 2042 bp, Homo sapiens
  misc_feature (1888)..(1888): n is a, c, g, or t
cagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaacgccacggggggtgtcagacacgagacaggcataatcagcgcagaaatgtgaggcttgtaagactgcgtaataacatgagagggaactatcgaatgggggtatgtaaagccgtggcgaagggaagacagagacaacagaaatcagtgtacaatanatgcatactagggtcagaatgggatatggaaaatggtgcaaatcacgtaatagtcatttaaataaggttatagtgatatacatattcgtagtgctggtacgctgaagtaagtgaggtaaaaggtgattactgttctatgtagttttccagagct

SEQ ID NO: 325228 - DNA, 1640 bp, Homo sapiens
cagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggagactgaggagtgttaaagtgaacagacgctttcttgactactgctagtgtcgtccatcacctttgttttaaaacaggtcttaagggtatttcctaatatttaaaaatgttgatggtattttagggtttgtttggctttaatttacgtctacgtttttttttccactgtcaagtagctgttgttcataagagcataatatgagtggtcaaatagcctttaatgatgcagcaaggatgg

SEQ ID NO: 325229 - DNA, 737 bp, Homo sapiens
gggtttgaggaggattcagtgttgttaaaacattttgtaaggcactgtgtagccataaagctcaacgtttctgatatccttcagcataagaatttaataatcaacccaaaatagagagacatgaatatttgtggtcttgattagttagaaaattgctgtacttattttggggtttttagttatttgggagaaatattttaaatctccgtgtgtgtgcattctttacttgcgtgtagtccttattgtgaaagggggatgactttgttatgtattttttgtgactaaactttaattgatccttctgtttcttaatctgttcttctccagatcactgattttatgagttttcagaatagtaagtaagggtatgaagacttacagtaactaaagcaatgttcatggggaaatctatttttacacaggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagt

SEQ ID NO: 325230 - DNA, 3343 bp, Homo sapiens
cagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatg

SEQ ID NO: 325231 - DNA, 3666 bp, Homo sapiens
cagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaaggctgcatagatgaatggtttgaagtaaatagatcttgccctgagcacccttcagattaagcgtcagcttcctgttttataggttttcttgtcttgacaagatgcttgaaaaaccaagaggatatgaaaatctgtctctggagaaacaaagacgcaggcatactcagccagaaatctgagttttgtgagacttggtaatacagagatggacaatcgtactggggtaaaaaaaccctgctgaagagaggacagtgaccacagaactcagtgtaccaaacatgcatacaaaggacacacagggattttgaaaatgctgcacatcccttaatagtcatctacataggtaatactgataaacattttgtattcagacgccaaagttaactgatttaaaagttgatttactttttattaagttctccagagctgcacaactagttatgttttgatttgttttgttttttaatttggggtctctttgttttccccaacataatgttcataatgtttctgcattcatctgttcttaaattgaaaaacatataatttacttcttataaattgaagtcttaaatgtgaaaccaagaaatgtaatcaagcagtaaaaacatctgaatgtagaccatgatctcaagttcttccattttctcccccacgagtggaaaatagacttctacataggaaagctaaaatatgttaatatttttaaattaaaggtttaatatcagaatgcagtccaaagagcaaatcatattacataattacattttaattaaatatagaatattctactgaattgcaatttattaaatattcttatcctcttaaataaaactgctcaacagttaatcagcagtgaatcatcttgcagctatgcaatttaaaaaaaatacagattaccaatttcaagtgctgccagctaaaataactgttttaacgggtatcttttgtttgttcttttcacttaattattttattgtgctttgcatctccaggcagttctctcacatttgggtaaaatgtttagcaggctgtaaacttaagaaaagggtaaaataaaattttctggagaggaacttggaatttgagggagattttatatacctttaaaaactgtaatttaattgggatgccaggtttatagcaatttgcaactttaattttccagataatctggaggttagcatttgataaatgattttttaaagtagatatgaagattttgttaatttataatttattcatgtgttattactgtaattgaaaatgttatagacacttttaaattcagtttgtgtagaaagaaatgtgttaaacaaaattatgttaataaatattcccacataatacatctgaatggttaaaaatactggaagagttgtcagggctacaatagtgaatgtccttttttttaatatcaaaaatatcgataagtaggttttgtgttttcaacgtagggaaaatgttatcagtgaataggtggtgtactttacttggtataatttaaagttgcacagtaagtactgtttccttattttaatctttctttactcataatgtatttaagaatttgctgttttatttaacgctgctactcttaatcttctctaaatttttccccctactttcttgcttctgtttcacattttttaaaagggcaagtacaggagcaactgctgctacccagaaaaatgtgtgtattataaataattaaagagtttttaattgctttctgtatgattccagctcagataacattttccctgaagttatgctgtgaaatgccttttgttatgctgcaattgctaaaggaatccaaaacctccattgtgacagctgaaggcacagtttaataggtgcttttttactagttatgaaaaatattcgtcccttaaggaaacgattctttttctgtttttttctgttaccatgaagtcttaatttgatttcattttatttcacatttttgattttgtaagctttcataccctcctgctcaaccccctcaagtaaaacctcttagaatgtgaataattggttcattttctattgctggtatact

SEQ ID NO: 325232 - DNA, 2063 bp, Homo sapiens
cagagacctgtccatcaccgagtccacgagtggcagcacctaccacaccgcagtaccttggcgaggcggagcaggggcaggcaggtcgcggaagggggaggcggagcaaggccggcgggagccaatcggcctggcggcacgagggggcgggggcggggtcaacgcgcgcgacccaaacacacgggccgggcgcaccctgcagccgcgccgctccgcggccttccggcgcggggccggggaacctcctccccatctgcgcaccccccgccttcgcggcccagatcctcccgccagcccggcccctccttcgcagggggagcgaggcgacggttgccgggaagcgcgcgccacctctccctcccatttttcgttctcccctcgcgcgccacccgtttttcctctttctccgttaataacagctgggtggctgggggaggagggaaggtggccccggcggagtctgggcgggcgcctcccactcagccgccagccgccgtgggagccggaggatggcggcggtagcagcggccgcccgagaggaggcggtgccgagatcgggggcgccgagcgcggcagcagagagcggtagcggcccgtcgtggcgcaccagaaccgaaaccagcggcagccgcacggccacttgagccgccccttcctgctggagccagcgaggggtgcctgcagccgggaccccttcctctccgcgtctcctcgtctcccgcgcccgcgtcaggccgtcggcctcgcccgccgccccaagaagagcgcgccgggcgccgactgcccctctggacgccgggcggcggccctggacgtgcgggggcctctctgggccggccgcggcgcctgggccctgccctctagctcccgcgctcgctcccgccctcccggctctcggggcgcagcgcgcgggcccggcccggggcagggcggacatgggcgccaaacagagcggcccggccgccgctaacggccgcacgcgcgcgtactcgggctcggatctaccttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggatttaagtgccctgtatgctcaaaatttgtatcctcagatgaaatggatttgcatcttgtaatgtgtttaacaaagccacgaataacctataatgaggatgtactgagtaaagatgctggggaatgtgcaatatgccttgaagaattgcagcagggagatactatagcacgactgccttgtctatgcatatatcataaagggtaagttcaccaagttggtattagagtaaaagattgttctcacagtttcagacattgtaattagggctgaaaaggaatcttcgttgaaaccaccccctccctgtctcacacacacttcttaaaacttaatgatcttttttctctatttgaactaagacttgaacccacatctgtttgtatccaaaaggctactatttttaaagcatttgctatgacccagctgttgtccatagcttcttgaataaattatctcatgtaagccttgtaaccattgcattttacaattgagaaaataagctaagggacagtatggaattgccccaaggttacaaggctagtaaatggcagagttgagattccagtagatttggaatctgcttgactccaaaacctgtctgctttctcatatggtcttcttgcttttagagtgatacaggaaaaatttggggttaaaaaa

SEQ ID NO: 325233 - DNA, 485 bp, Homo sapiens
gcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggtacggacccctctccgcgcacccgcgctcggtcctcccgcggctgcacgtgggccgtggccgccggctatttttacccttctccttttctccttctgccggggcgccgggggctgcctcccggaccagcccgcgtcggtctccatcctggaagaaacccggcgcttaacaccggcggtgccgctaccgcatagacgcgtggttttgtttttaa

SEQ ID NO: 325234 - DNA, 419 bp, Homo sapiens
ataaagacgcagagcctcagagaagttaaacgattgatcctatgtcagggggtagagtcaagactcatacctatgccttttaacttcaagattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggagttctaaatggtgcactggatgttgaaaaagttgatgatgagcaagaacaaaattcctcctttcaggagacttacagttcaatatgggaaatgtaatttgttaaaatataaaagtgcaattgtgttacatgctgtacgaagtacatgttgacatgtgagtatataat

SEQ ID NO: 325235 - DNA, 182 bp, Homo sapiens
gcctccactttctcacttccctttccttctttaaccagctccaggcaggcgtttgtccccaccacgttatctactgaaattgctcttttcaaggtctccaggagcctctatcctgctggttatgattggttagttcttcgtcctcgtttgaccagtgggtaactcccattttttttgttttt

SEQ ID NO: 325236 - DNA, 196 bp, Homo sapiens
gggaaggagtattcctggagaggggaagagcaaatggaaaagcacgaagcaactctgacatatggaagttcttgagatcgacaatggctgactacaggagctatctggaaatgccacaaagcaattttttcccctagaaatacatgtgcacagaaagaaccatccagcttggcgtcaaggtttactatgctttcca

SEQ ID NO: 325237 - DNA, 609 bp, Homo sapiens
attcgcggccgcgtcgacggaatgctcatctcaagatctatccagttttatttatgttttgtatgttagatattttatcaataaattctagcttcacaactaagttagaaggccctttcacacctttttatgtacatagtgcccttctgtgacgtggaggttgaatagcaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctggtgagtttggggttagacagtagaattacctgacagtttctgaggcagagtctcagttttactcttgacttgacctcggcctttttcataatcctattcaaatcatgtgttcctttcgaaaatgtctccattccactttccagtcatcgcagcagcaaaagcttttacaggggtttctcaattatttacaaatgaagtaaaagaatatcttcgaaaa

SEQ ID NO: 325238 - DNA, 2677 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggcttactatccatggtcttggaaaagattgtcccttctcttgctgttgtaatgcatctctgctacagcagtcattgtcatcctgtgaccttatcccttttgtctcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaagtggtgacggcaggatggccctgctcagcaccgcaagagccatggctgtccctgttggcccagccgggcactcacggggcagaagggtgggtctcaagtgggaggataaggcttcaccaccaggagattcccctctgcccgatgactctgataagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaa

SEQ ID NO: 325239 - DNA, 3544 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatca

SEQ ID NO: 325240 - DNA, 3427 bp, Homo sapiens
cacacattgtgttcttaaactgagacgtggctctgcaggtctcctgggctcattccatggtgtggtatgtttattccactgtccagagctattctctgatggatttgagcaacagcagtggagataaatgtcctagagtcaccaggtcgcttggagaagtcatttaagctgcctcgggtttttgttacttaaaatgtggatattatttctccacctaaatcactgagtttacagagtaataatgtgttgctctggacattgacagctttctagagccagtaatgggctcttctgaaggatgctgaattagaagtgaacctattcataggatcaaaagccacttgctttgaaatatgtagagttcctcagaattgacggtgctagaaatatccaagtgttaaataaccttttaaaagcaacaaaagctacttttttcttaccacttaatagaagaacctgtccctagaggcgacttcattgctatggatctggagtctctgaactcttaataggatgcagcctcacatacataatgtcacccattttatgttgatgaaaacattacaagttttcatcattgggtatgtgttgatgttcacagacagtacttgggcccattaggttttcgcgtctggtcttagagcatgtgtattcatctcagcgtgaatacctcagccagtcttatgaataggaggctatgtatgggcagggaatagattagattagaacactcgcacaagatgaccacatatagaagcagaaagccccaaattccctgggaactgttttttctctagtagctgaatataaggaaatatgtctaatggacaccagttaatactttttaaaactactctttaaaaaaaaaatacgttccccttggttaactgattttttaatccagggtggacattttttcaacctttattaaaaagacaaataaactattttgtagaagatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatca

SEQ ID NO: 325241 - DNA, 3706 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgcagagcgtggacgtgcccggagacctaccaggcctctcgttggcggcagccgctcggggtgctgcggcgcgcgagtgatgaagggggtagaaccgccgagcgtggcccgctgtgagagcgagctttctgagcgacggtgcagcatgtgctgcgcatgcggacagcagggcacgtgagggccgggcattcactaggcgggctaggtcggtgcagcacgtgcggtgccgcttgacctcgtgttcggctgcgtttgcttgtctcgcctgttccccttggcgtcccggctcactgtcgccccagttcccttgtgttgccgagtcgcgcgtctagggtggtttactgccacgcggctgttctgtccactgagaacggctgaatcattacactgaagagcgtctctggggccccgggagacgacgatccaaggtatgtcggtagacagttgatggacgcttgtctggcaacaaacttttatatttaattgcttgtgcgaaggcttccctctttgaaagctgactttgggaacggcaagccaccaagctatccccaataaaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatca

SEQ ID NO: 325242 - DNA, 2937 bp, Homo sapiens
attcgcggccgcgtcgacggaatgctcatctcaagatctatccagttttatttatgttttgtatgttagatattttatcaataaattctagcttcacaactaagttagaaggccctttcacacctttttatgtacatagtgcccttctgtgacgtggaggttgaatagcaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatca

SEQ ID NO: 325243 - DNA, 2483 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggcttactatccatggtcttggaaaagattgtcccttctcttgctgttgtaatgcatctctgctacagcagtcattgtcatcctgtgaccttatcccttttgtctcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaagtggtgacggcaggatggccctgctcagcaccgcaagagccatggctgtccctgttggcccagccgggcactcacggggcagaagggtgggtctcaagtgggaggataaggcttcaccaccaggagattcccctctgcccgatgactctgataagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaa

SEQ ID NO: 325244 - DNA, 2101 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgttccgttgtggaacgctgcccctcatttacataaatattatactagcatttaccatctcacttctaggaatactagtatctcgctcacacctcatatcctctcttactatgcctataatggaataatgtctatctctgttcattattaagctactcttataaccctcatcaccctcattccttt

SEQ ID NO: 325245 - DNA, 1582 bp, Homo sapiens
agaatatgagaagttaaaccagggaccatgccagaaggttctctcactgatcccccaagtacagtctacagaaaactaccttgactccactcctccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggactattgaacagcccattcatttatttctgttttgtttaccgacatattcagtattattcttgttttctgaattctgagtctcctgaacaaaaggcttactatccatggtcttggaaaagattgtcccttctcttgctgttgtaatgcatctctgctacagcagtcattgtcatcctgtgaccttatcccttttgtctcccatcaccttttccttcttcagcagcacctcacagtcagtcagacgctgcaggcaccactatcaccaggagtggccaagtaaaccgagacaccagtaacagcagggctggacttcctccagcgttttgggaaggaaagagatgttcccctgagctgattcccagtgacagtgcagcaagactagtgggactcctctttcccacattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaagtggtgacggcaggatggccctgctcagcaccgcaagagccatggctgtccctgttggcccagccgggcactcacggggcagaagggtgggtctcaagtgggaggataaggcttcaccaccaggagattcccctctgcccgatgactctgataagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaa

SEQ ID NO: 325246 - DNA, 942 bp, Homo sapiens
ggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaaaaaagaaaggttgttatggactggacacccctgaagcccattgcctaggccacagtggtgacggcaggatggccctgctcagcaccgcaagagccatggctgtccctgttggcccagccgggcactcacggggcagaagggtgggtctcaagtgggaggataaggcttcaccaccaggagattcccctctgcccgatgactctgataagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaaacatgcctctctttgctaatcatttcagaggtccagttttcctttcactggacaatcttgaataggaggaacgctgttgctgtaatatgcgtagcttgtgtgtgctcttgtgtagtctgtgtgtgatcaaagggcacggaagtggctgcactttcacatcccttttctttacttagctggaaccttacataccagtacatgctcctctgtaagcagctgaactcaccggccacttctctgtttgcctatagacaaagactgtgtgtgtgtgtgtgtgtgtgtatgt

SEQ ID NO: 325247 - DNA, 2833 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgcc

SEQ ID NO: 325248 - DNA, 3910 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatcacttgcgattgccagtcatttctgtgccagttgctttcattccagagaatggcctcattctccaaaaaaagatgatgattttagaagtaggatttcctaacaaattatgtggtggggagggacggcggggattttattcatcccgtctgagctcttcatacagtattaccattaggttttaagaacaaagatgggggaggagggagtagaaagctgagagtacgtagaacagctacaagacattagtgggtattcagattttgagctgtgtaaatatcaaacatcggcttccagccttaagagttatttgagcagagagttaaggaggaatgggagattttgtgaataaaatgttttgccaaactga

SEQ ID NO: 325249 - DNA, 4029 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcaatcagactcctacttaactggaagagaaatgtctattaaatgtctctcctctttctctgggtcaagaccatgtaattttatgcttcagagatgaagatactgtttgtttacaaagagtttagtttttaagacatccaaaactctatgctagagcaaaaatcaaatagcaaaggacactagccagaaaatacagtgtgtgtgtgtgcacctgtgtgcctgctgaacaacttgacagtgtaacagataaggtaactgaagatggtggatatttgaattgtattagcttaatgtctacatatctttggccaaaactctattgtcatattagaaacatgttatctttttcatgtttattagtaatttatttttgattctttgttttctttttcgtccaactaaaacaactgtaatgtacttgatacatttatatcaagttctaaagtatttagacaaatccaaatactttgtttttagttttttcctcctttccatcctgttaaccacagtgaaacgctgcagtattttgatttggtcagtgctacggaggaagaccatgaaagctgaattggtctgtgccacccagagtaaacctcttctcttcttctggaaagatggcgtgatgtttttcaaggattctaataaatatcccgcagtcatctcctgagcagctttcctctgtttcacttcggaactccttcccccactttcttcactccagtttcttcacttgcagcgttttctgctaagaaagacttatcatcttgtatctgtttatgcctctcttctttggggcccctggatgtttttgtggatttttacagagtatttatatctgcacagcgtgtattttgttatacattcttacaagcattgatattggggggtacatttataatagtgagaatatctggcagaatgtgtgaatgccatatctgtagatgacgatgaatgtgaagggttaatgtagaaatgtttgtttattctgttacagctcaaaatggaggctgagaatctctaccaccattcccttctctatttgagaatctctaccaccattcccttctctatttgggaaacaatactctcttattttgctatttttaccttcccattaactggcttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtctgttggtctgatctcagtatcatactgagacacctcccctgagccttacctacttaaattggtaaccgtcctaccaaaatttgtcaattttaatcaagtgaggcaagttgcaagggagccagagatacgtgaaaaaagaaaagcagaaatactgatactttctaagaaagaagttgtaataatttctttggcacattgacttactgatatcttttgaaatgcatagatgactcttgtgaaccaaagagagcagtagtggttattccccggcgcaataaaaatgcctttgtgtatcacttgcgattgccagtcatttctgtgccagttgctttcattccagagaatggcctcattctccaaaaaaagatgatgattttagaagtaggatttcctaacaaattatgtggtggggagggacggcggggattttattcatcccgtctgagctcttcatacagtattaccattaggttttaagaacaaagatgggggaggagggagtagaaagctgagagtacgtagaacagctacaagacattagtgggtattcagattttgagctgtgtaaatatcaaacatcggcttccagccttaagagttatttgagcagagagttaaggaggaatgggagattttgtgaataaaatgttttgccaaactgaatgagtctttttgccattattatagagagctattttttaccttctgaaacaactcatcagacatctggggtttatcttgaattgtaccatcattgtttcttaataaaagtgataaattt

SEQ ID NO: 325250 - DNA, 1543 bp, Homo sapiens
agcggctctatggcggagctgcctggcggaagcgggaacgtcgcatcctgaggtaaaggtgcacggcatcctgggacatgtagtctggccggggctcggacgccccctcggatgaatgggaccgaagctgactgcgaactacagcttcttggcagcgtcggtgttggccgcgggagaaggggagaccgcggcggcccccagtgagagcggctttccaggacggtgcgatgtgctgcgcagcgaagaggcaggaggccggcttcctggggtagcggtacaggcgggcgcttactctgtgcgcttgcttccccaaccctgcaccggccatgcgcccggccttggcggtgggcctggtgttcgcaggctgctgcagtaacgtgatcttcctagagctcctggcccggaagcatccaggatgtgggaacattgtgacatttgcacaatttttatttattgctgtggaaggcttcctctttgaagctgatttgggaaggaagccaccagctatcccaataaggtactatgccataatggtgaccatgttcttcaccgtgagcgtggtgaacaactatgccctgaatctcaacattgccatgcccctgcatatgatatttagatccggttctctaattgccaacatgattctaggaattatcattttgaagaaaagatacagtatattcaaatatacctccattgccctggtgtctgtggggatatttatttgcacttttatgtcagcaaagcaggtgacttcccagtccagcttgagtgagaatgatggattccaggcatttgtgtggtggttactaggtattggggcattgacttttgctcttctgatgtcagcaaggatggggatattccaagagactctctacaaacgatttgggaaacactccaaggaggctttgttttataatcacgcccttccacttccgggtttcgtcttcttggcttctgatatttatgaccatgcagttctattcaataagtctgagttatatgaaattcccgtcatcggagtgaccctgcccatcatgtggttctacctcctcatgaacatcatcactcagtacgtgtgcatccggggtgtgtttatcctcaccacagaatgcgcctccctcaccgtcacgctcgtcgtgaccctacgcaaatttgtgagcctcatcttttccatcttgtacttccagaaccccttcaccctgtggcactggctgggcaccttgtttgtcttcattgggaccttaatgtacacagaggtgtggaacaacctagggaccacaaaaagtgagcctcagaaggacagcaagaagaactgaggcctgtctggagtacgtagaccagtgtcgtcgtgagggtgggaccctgtgaaggtctgaccaccgtttcgcttttgttaatgccgagctacccgcagtgctgagccagccgtgcaaaaggaaatcttcaggaggggacttctcacgttgctcagactgacacatgtagactaaatagaaacccctcagccctaaaatagaaaaaagaacagttctggact

SEQ ID NO: 325251 - DNA, 614 bp, Homo sapiens
agactctcattcaactccaggttgcactgtggacacagtcccctcttgagcaggtacctccttgcagtggttgggacgtcctacttggctcatagttgggaagtgcatatgctggagctgaagcctcttgccttcccgggatagggcgtcctcacatcccctctgagaagttccccagcttccctctgttccccgtttccacacttagcgaggctcttgtccactgctacatcccccatagccagtccctcagccttgccactgcttatgctggtctggaaacaattcctagacttgtggggcatctggggaagttctccatctttttttagctggcatgacccaagtggtgtgggcagggctgtggattctatggtgtggctggaagccaggtagcctctctctactgtacatggaactcagcaacttctgagtcaagcaagatcttagctctgcaggtgtcttgccctgtccaaagttatggccacaccagtaccttttaactctagaagcccagtaagtgttttgtgggaccgcaaagatcattttctagacctgctgaatatgcctagaacgggtagggatggctttcacgctgttcctagggctgacaa

SEQ ID NO: 325252 - DNA, 3792 bp, Homo sapiens
acctggcaggaagcgagaaagagttcggcgaagaaggagtgagttctagagacgccccgcgagcaggacccgcgcctgcaggagagcctggccgacccgctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctcccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaac

SEQ ID NO: 325253 - DNA, 779 bp, Homo sapiens
  misc_feature (752)..(752): n is a, c, g, or t
tgtaaaagaatggaaatcacatttattgagtacctattgtatgcctggcactttaccatacattagatcatttaatcctcatcttatccctaaaagacaattaattccccattttcaaatgaggaaactgaaactcagagagatcaagaaacttacttcaagtcacacactaagccgtgacagagccagatgtttccacttcaccaacaacatccaaccactgtgacttggaattggaatcagaaagcaagattattaagagtaaagtttgacacaccatcctaaagatcccataggaatggttaactcatgaagcccatgcactactaaagaaatccaggttgtgagttcaatggagcccggcccctgccttgagtacaagggagaagcagacagaagagtattgagacatcagcaaaaatccatcccccacctagaggaaaagcttggagattaaagaggagtgctgcagtcattgttgtagactgccacaaagggttaatgcaagtggtttctttgtctttctgtggctttcctacgtgagctgggtgaagagattccaggccagggagccaccgatcttgctcagaagctagtctctccagtgcagtgccagggccagtgaaacagcagggactggtggaaaggtagagctgtagggaccttctccaatttgaattttctatctctcacaatgagctagtcaaacactggttacgtgcagtcgccctacacggcctttggctgctcgnactttggcatatgaattccgttttgga

SEQ ID NO: 325254 - DNA, 774 bp, Homo sapiens
  misc_feature (729)..(729): n is a, c, g, or t
tgtaaaagaatggaaatcacatttattgagtacctattgtatgcctggcactttaccatacattagatcatttaatcctcatcttatccctaaaagacaattaattccccattttcaaatgaggaaactgaaactcagagagatcaagaaacttacttcaagtcacacactaagccgtgacagagccagatgtttccacttcaccaacaacatccaaccactgtgacttggaattggaatcagaaagcaagattattaagagtaaagtttgacacaccatcctaaagatcccataggaatggttaactcatgaagcccatgcactactaaagaaatccaggttgtgagttcaatggagcccggcccctgccttgagtacaagggagaagcagacagaagagtattgagacatcagcaaaaatccatcccccacctagaggaaaagcttggagattaaagaggagtgctgcagtcattgttgtagactgccacaaagggttaatgcaagtggtttctttgtctttctgtggctttcctacgtgagctgggtgaagagattccaggccagggagccaccgatcttgctcagaagctagtctctccagtgcagtgccagggccagtgaaacagcagggactggtggaaaggtagagctgtagggaccttctccaatttgaattttctatctctcacaatgagctagtcaaacactggttacgtgcatcacgnaatttcatccttttccttatcccatacctccgagcagcggggcct

SEQ ID NO: 325255 - DNA, 776 bp, Homo sapiens
tgtaaaagaatggaaatcacatttattgagtacctattgtatgcctggcactttaccatacattagatcatttaatcctcatcttatccctaaaagacaattaattccccattttcaaatgaggaaactgaaactcagagagatcaagaaacttacttcaagtcacacactaagccgtgacagagccagatgtttccacttcaccaacaacatccaaccactgtgacttggaattggaatcagaaagcaagattattaagagtaaagtttgacacaccatcctaaagatcccataggaatggttaactcatgaagcccatgcactactaaagaaatccaggttgtgagttcaatggagcccggcccctgccttgagtacaagggagaagcagacagaagagtattgagacatcagcaaaaatccatcccccacctagaggaaaagcttggagattaaagaggagtgctgcagtcattgttgtagactgccacaaagggttaatgcaagtggtttctttgtctttctgtggctttcctacgtgagctgggtgaagagattccaggccagggagccaccgatcttgctcagaagctagtctctccagtgcagtgccagggccagtgaaacagcagggactggtggaaaggtagagctgtagggaccttctccaatttgaattttctatctctcacaatgagctagtcaaacactggttacgtgcagtcggctacaaatctcccactattacagacgtatttaaagtgagcggagcgcg

SEQ ID NO: 325256 - DNA, 777 bp, Homo sapiens
  misc_feature (730)..(730): n is a, c, g, or t
tgtaaaagaatggaaatcacatttattgagtacctattgtatgcctggcactttaccatacattagatcatttaatcctcatcttatccctaaaagacaattaattccccattttcaaatgaggaaactgaaactcagagagatcaagaaacttacttcaagtcacacactaagccgtgacagagccagatgtttccacttcaccaacaacatccaaccactgtgacttggaattggaatcagaaagcaagattattaagagtaaagtttgacacaccatcctaaagatcccataggaatggttaactcatgaagcccatgcactactaaagaaatccaggttgtgagttcaatggagcccggcccctgccttgagtacaagggagaagcagacagaagagtattgagacatcagcaaaaatccatcccccacctagaggaaaagcttggagattaaagaggagtgctgcagtcattgttgtagactgccacaaagggttaatgcaagtggtttctttgtctttctgtggctttcctacgtgagctgggtgaagagattccaggccagggagccaccgatcttgctcagaagctagtctctccagtgcagtgccagggccagtgaaacagcagggactggtggaaaggtagagctgtagggaccttctccaatttgaattttctatctctcacaatgagctagtcaaacactggttacgtgcaggtggcnctgaggtgttgtttcttgttatagactataagtatagtagggttaag

SEQ ID NO: 325257 - DNA, 3666 bp, Homo sapiens
tgtaaaagaatggaaatcacatttattgagtacctattgtatgcctggcactttaccatacattagatcatttaatcctcatcttatccctaaaagacaattaattccccattttcaaatgaggaaactgaaactcagagagatcaagaaacttacttcaagtcacacactaagccgtgacagagccagatgtttccacttcaccaacaacatccaaccactgtgacttggaattggaatcagaaagcaagattattaagagtaaagtttgacacaccatcctaaagatcccataggaatggttaactcatgaagcccatgcactactaaagaaatccaggttgtgagttcaatggagcccggcccctgccttgagtacaagggagaagcagacagaagagtattgagacatcagcaaaaatccatcccccacctagaggaaaagcttggagattaaagaggagtgctgcagtcattgttgtagactgccacaaagggttaatgcaagtggtttctttgtctttctgtggctttcctacgtgagctgggtgaagagattccaggccagggagccaccgatcttgctcagaagctagtctctccagtgcagtgccagggccagtgaaacagcagggactggtggaaaggtagagctgtagggaccttctccaatttgaattttctatctctcacaatgagctagtcaaacactggttacgtgcaacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctcccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaac

SEQ ID NO: 325258 - DNA, 3572 bp, Homo sapiens
ccctcacacttggaaggtggagagattagctttctttttccttctagttcagtcctttggctactgtgaaagaccacgcagaagctgtggacttgctttttgtgcttgacaaaagtgcatagatagaagacagggattcccggctgggaggagggaggagagctgaagatccctgcctgggctggctgagctaagcaaagtgggaagctgagtgcttgaaagaggattatgctcgcactagaaataagcaaaaagtaaagaacaaggatatggaaaactaagcagtgatgaagacctcgaaataattgttgatcaaaagcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctcccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaac

SEQ ID NO: 325259 - DNA, 3786 bp, Homo sapiens
acctggcaggaagcgagaaagagttcggcgaagaaggagtgagttctagagacgccccgcgagcaggacccgcgcctgcaggagagcctggccgacccgctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcaggtagtaggtgtaaccttgaagaaaaagtggcactgtcttcaaaaaagtgacctgaccctggctttgggaaaaggctctagggcggcagataaggctgttgccatggtgatgaaggagataccgagggaggagtctgctgaagaaaagcccctccttactatgacatcacagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctcccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaac

SEQ ID NO: 325260 - DNA, 3687 bp, Homo sapiens
acctggcaggaagcgagaaagagttcggcgaagaaggagtgagttctagagacgccccgcgagcaggacccgcgcctgcaggagagcctggccgacccgctcctcgccttctctgcgcgctctcccgcgtccgctttcagcaccccgagcggagaacagttcccggcagcccgcagcgctgccgagtggccgccggccggccgagtacccggagctccagggggctcaggagcaccctctgagaacccgctgtgcacccaccttttcccctcttttggtgggcaagtaagcacgggggaaaagcatccggtggcctcagggagccctgaagaaaccgaagcagaatgtaccagggacacatgcagaaaagtaaagaacaaggatatggaaaactaagcagtgatgaagacctcgaaataattgttgatcaaaagcagctggtgaatgagcaacaagaaagcagacccctcctgagtccctccatcgatgactttctctgtgaaaccaaatcggaagcaatagcaaggccagtaacatccaatacagctgtattgaccactggcttagatctcctcgacctgagtgaaccagtctctcaaacccaaaccaaagccaagaagtcagagccctcatcaaaaacctcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccaatggcagagagaaaatcatcctcatctagaactggatcaaaagagctcttatggtcctcagaacacagatctcaaccagaactgagtggtggaaaaagcgccctcaactctgagtcggcttcagaattggaattagtggctccgactcaggctcgactgaccaaagaacatcgctggggaagcgcattactttctagaaaccactccttagaagaagagtttgaaagggcaaaagcagcagtggagtcagatacagagttttgggataagatgcaagcagaatgggaagaaatggctcggaggaactggatatctgagaaccaagaagcccagaaccaagtaaccatctcggctagtgagaagggatattactttcacactgaaaaccccttcaaggactggcctggagcatttgaagaaggcttaaaaaggctgaaggaaggggatctgccagtcaccatcctgttcatggaagcagcaattcttcaggaccctggagatgcagaggcatggcagttcctcgggataacccaggcggagaatgaaaatgaacaagcagctattgtcgccctccagaggtgcttagaattacagcccaacaacttaaaagctttgatggccttggctgtgagttatactaacactggccatcagcaggatgcctgtgacgctctgaagaattggattaagcaaaatccaaagtacaaataccttgtgaaaagcaagaagggatctccaggcctcacccggcggatgtctaagtccccagttgatagctctgttctggaaggggtgaaggaattatatctggaagctgcccaccaaaatggagatatgatcgacccagacctgcagacaggtctaggggttctgttccacctgagtggagaatttaatagagcaatagatgcatttaacgctgccttaactgttcggccagaggactattcactatggaaccgcctcggggcgaccttggcgaacggagaccgcagcgaggaagccgtggaggcctatacgcgagcactggagattcagccaggattcatccggtccagatacaacctaggaataagctgcatcaacctgggcgcctacagagaagcggtcagcaattttctcactgccctcagtttgcaaagaaagagcaggaatcagcagcaagttcctcatcctgcaatctctgggaatatctgggctgccctcagaattgcgctctctctgatggaccaaccagaactcttccaggcggctaatcttggtgacctggatgtcctcttaagagctttcaacttggatccttgaagaaagaataataccagtactaataatccctgatctgtgtgattgtactgaaaaatcaaaaactattttattatgaatttcaaaaggataaatcaaatattcaaaaggccatggtcatatagcccaaggaaattaattcctgtggacaatgcccagtctctgttcagatccaaaagcacaaaatgttgtatatagagtcaaagtcaggctcaaaagaagaattaagagactcaagacaaaccaagataaagtaactgtgtgttgaatactctttccacaagttgcaagcatattgcaacacatgttctttgggttttttgtctcccccttgcagctgatgacacatctgaggaacttgttcatgggaaacatggaaaaagcactgcctcagattgggaaattctgactgtttctgaactgtcttcttttgcaagactgaacatagtttgggccattggtgcatgcacatatattaacttgtgactaaagacagacattgcttaaacctgttccaattttaacttttactgtagccctttgattccagagagggagctttgctggcaaaagcagtttttgcactagaaatttttgctgttcccaatctaaacttttctggtattgtatatatgcactttaatatcttatttatgccttgctggagttttgttttgttgctccaatttttaacttgggggtgaaagatttaagaactcagcctcactagatcaacggaccaaataaacaattcctgaagacagtttttcatagtgtaggattttgaagaagtgtttttcttaaagcagatacgatgacataaggcgtaaatatggcaaacagatcttttcattcacgtgctttctgggtctgtatgaacataagtaagacacaaggtactgtctcttcatgcattctctgcaggaagaaagtttgatggtatcgtgatttctattgagttcaaattaacttgcttaagtgtcatactttactggctttgccctgcacaccaatattccttttaaaccataaatattttaaataatatttcttaagagtgataaataacattttttcctaaaaattatgttttcttagtttcataataatctgcactgttcatccccttgcattctaagtgatagaagagcaacactttcaaaccaaatctcactgaatgccagtgatttcatatgaaagatgcatgcctctttggctctttgaacatttagcaagtattgggaattttctattagcagtggtgttttaattggttgaattccacttagttctccacagtgttttgtatgtgtttggggcttggtgattattttgaaagatacattttttaaagaattaggaacattttttgcaaaatgctaatcagaatataattttcccaatgtcaggtatagaagttatcccattcttctttacctggtctccttccttcgtctagaaccttccccacagtagctaatcctaacaactttttatttatgttctttgataataatagctcatcccgctcatgattatagctacccacaaaaaataaaacaacaacaac

SEQ ID NO: 325261 - DNA, 282 bp, Homo sapiens
tgcactccagcccgggcaacagggtgagaccctgtctcaaaaaaaagaatagcccagaagttcttactactaaaaatttaatctttatattgccaaaattaaaaatgaatacacatacgaaaaattaagtttcatgtaggactaaatttgggtatgtgcagaaaaactgtaaagaaaactagtgaaatgtttgcttcataaaatatctttaaagaaataaaattctagactcacacttgtaaccccagagttttgggaagctgaggtgggaaaatcacttaa

SEQ ID NO: 325262 - DNA, 397 bp, Homo sapiens
caagaaactgaaaagacaacccacagaatggcagaaaatatttgtaaatcatgtatccgataagggacttgtatcccaaacataaagaactcttacaactcagcaataaaaagacaaataatccaattcaaaaatgggcaaaggatgttaatagacatttctccaaaggaaatatacaaatgatcaactggcacatgaaatgatgctcactaccattgttcattagggaaatgtagatcaaaaccacaatgcaatacttcttcacatccactaggatggctaaaatcaaaaaaaagaaaataagttttggatgtagacagaacagaaaccctcatacattgcaggtaagaatataaaatggggcagctactgtggaaaacagtttggaagttgctca

SEQ ID NO: 325263 - DNA, 96 bp, Homo sapiens
tgaccactttccttgtgaaacttaagttccaatgggagaatgacagtaaacagacaactattataataagtgcatggaagattttggtgtatgtta

SEQ ID NO: 325264 - DNA, 1333 bp, Homo sapiens
tgttaataagagattctaactattgcttttaccttcagtgtgaactagtgtggtaacaactttgaaaaggcaggccgggtgcggtggctcacgcctgtaatcccagcactttgggaggccaaggcgggtggatcacttgaggtcagaagtttgagaccagcctggccaacatggcgaaaccccatctctactaaaaatacaaaaaactagccgggtatggtggcacatgcctgtgatcccggctacccaggaggctgaggcaggagaatcgcttgaacctgggaggcggaggttgcagtgagccgagattgcgccactgcactccagcctgggcaacagagtgaaactctgtctcaaaaaaaaaaattgaaaaggcaaatgtgattgaatatctgaaaagctttaaaagtggcctttctgttacgtctgtggcacaaatggctcatgagcgcaggacacttatggtcttgtgtcctatacttcatgtgtgatgccaccagaaatgttatggattccgtattgaacacactgagagtggtatgagccctcaggactgcaccacagagtaaacacaaccttgatatggtggcgaatatgtgtgtctttcttgtttcatttgtggttggggacaaaatcgatgtatttgtctaaatagtcgatattcatcttaacatggttggttgtgtaatcaccagctatattgtgaactgtgcaataaaacagaagcgtttgtgtatataattacctttggatacctgaaattcccaagcttggttacaatgtaatgctcagtataaggctgtgcaaacatgtaagggaataatggtggtcgatgggatatatgaaatgggatctagagggcttcgagtgaagccaatcatgttgaacgaacactggttcagtgtagatgaagtagagtgaggcgtatgcagtcataaaatgaagggtggacaggagattacatttgaagaaaggataagcactcagacttggtctcttttaaattaaaatatttcttttctcatgtgcaaatgtatatcaaagacttgaacaggtattctcttgaaatttgaggatttttagtttttaatgctgtctttgcttaatattaaatatgtgttgcctattggctcccaaattgtgtgggagtctctaaatgtttcctcttgaaggttcattattgaaagtggttaagtgcacaatgctatttttgtttgatagtttgagttttatgaccctatgagtttaaatgaaatctgttaaatgtttcagagttaacactttttttttgataatttggaataaagtttgttttttaagcccaaaaaaaatg

SEQ ID NO: 325265 - DNA, 1295 bp, Homo sapiens
  misc_feature (1250)..(1250): n is a, c, g, or t
  misc_feature (1258)..(1258): n is a, c, g, or t
  misc_feature (1260)..(1261): n is a, c, g, or t
  misc_feature (1273)..(1273): n is a, c, g, or t
  misc_feature (1275)..(1275): n is a, c, g, or t
  misc_feature (1281)..(1281): n is a, c, g, or t
  misc_feature (1283)..(1283): n is a, c, g, or t
tgttaataagagattctaactattgcttttaccttcagtgtgaactagtgtggtaacaactttgaaaaggcaggccgggtgcggtggctcacgcctgtaatcccagcactttgggaggccaaggcgggtggatcacttgaggtcagaagtttgagaccagcctggccaacatggcgaaaccccatctctactaaaaatacaaaaaactagccgggtatggtggcacatgcctgtgatcccggctacccaggaggctgaggcaggagaatcgcttgaacctgggaggcggaggttgcagtgagccgagattgcgccactgcactccagcctgggcaacagagtgaaactctgtctcaaaaaaaaaaattgaaaaggcaaatgtgattgaatatctgaaaagctttaaaagtggcctttctgttacgtctgtggcacaaatggctcatgagcgcaggacacttatggtcttgtgtcctatacttcatgtgtgatgccaccagaaatgttatggattccgtattgaacacactgagagtggtatgagccctcaggactgcaccacagagtaaacacaaccttgatatggtggcgaatatgtgtgtctttcttgtttcatttgtggttggggacaaaatcgatgtatttgtctaaatagtcgatattcatcttaacatggttggttgtgtaatcaccagctatattgtgaactgtgcaataaaacagaagcgtttgtgtatataattacctttggatacctgaaattcccaagcttggttacaatgtaatgctcagtataaggctgtgcaaacatgtaagggaataatggtggtcgatgggatatatgaaatgggatctagagggcttcgagtgaagccaatcatgttgaacgaacactggttcagtgtagatgaagtagagtgaggcgtatgcagtcataaaatgaagggtggacaggagattacatttgaagaaaggataagcactcagacttggtctcttttaaattaaaatatttcttttctcatgtgcaaatgtatatcaaagacttgaacaggtattctcttgaaatttgaggatttttagtttttaatgctgtctttgcttaatattaaatatgtgttgcctattggctcccaaattgtgtgggagtctctaaatgtttcctcttgaaggttcattattgaaagtggttaagtgcacaatgctatttttgtttgatagtttgagttttatgaccctatgagttaagnaccgtaantnnaagtaccttttngnatgganangtggtctcgccc

SEQ ID NO: 325266 - DNA, 554 bp, Homo sapiens
aaaaaagagagagggtcttgctctgtttcccaggctggaggacagtggtataatcctacctcattatagcctccaactccagggctcagtcgatcctcctgcctcagctacttgggaagctgaagtgggaggatcacctgagctctggaggtggaggctgccatgagccatgatcgtgccactacactccagcctgggtgacagagtgagatcctgtctcaaaaaaaaaaaaaaatcacccttaaatcaacaaaaagacctcatgctcatgcagtggacatttcttggcctgttttcctgtgggttttcttcagcatgatatgaagcaactgttggcatagccagtgggataaataagaaatggaatcatttggctgcctcgtcacttgtgctaatggtcagttgtacacacatgacatgtggaagtgacctgtagcagcggtcactcattttaacaattgaactctgctgggttgggtatttacctttgtctagaaaagaaatatgatatattttctctaaataaatttattttcatcattccatatggcatt

SEQ ID NO: 325267 - DNA, 1537 bp, Homo sapiens
atgatttatctgggttacacattctgtggctggattgtcttaggaccataccatgacaagtttgaaaatctgaacacagttgctgagtgtctgttttctctggtcaacggtgatgacatgtttgcaacctttgcccaaatccagcagaagagcatcttggtgtggctgttcagtcgtctgtatttatattccttcatcagcctttttatatatatgattctcagtctttttattgcacttattacagattcttatgacaccattaagaaattccaacagaatgggtttcctgaaacggatttgcaggaattcctgaaggaatgcagtagcaaagaagagtatcagaaagagtcctcagccttcctgtcctgcatctgctgtcggaggaggaaaagaagtgatgatcacttgatacctattagctaaagttctgctaaagatgattaaagttcaggcatccttatccagcggctgagcagaggaaccccaaatgacttggacaagcagttccaaaatgactctcttatttaattgtggagtgggaaagaggactcacagttagccagctgaccatgactgaagttccagctttactttttataaacttgaatgataaagaatagaccatgggctactactgggcattagtgcaatataacagcgataataaaattctctattagtctgttaatttatgacatgatctcggaatggaaaaagatcatttcagagtgtgcgaaataatagtctttaaccatgtaattaaatatgtgtgtttattgtcaaataaggatttgttttaaaggtgattcttgggtttgaagacatttgttaattcatggtctgtacagaaatgaagctggttgcaataccaatctagagagtccaagctggcgaactattaagctgtttaaagatcacccttggcctggcacagtggttcacacctgtaatcccagcactttgggaggcctaggcaggcagactgagctcaggagcttgagaccagcctgggcaacatggcaaaaacccacctctacaaaaagtacaaaaattagtcgggcgtgatggcaggcatctgtagtcccagctacttgggaagctgaagtgggaggatcacctgagctctggaggtggaggctgccatgagccatgatcgtgccactacactccagcctgggtgacagagtgagatcctgtctcaaaaaaaaaaaaaaatcacccttaaatcaacaaaaagacctcatgctcatgcagtggacatttcttggcctgttttcctgtgggttttcttcagcatgatatgaagcaactgttggcatagccagtgggataaataagaaatggaatcatttggctgcctcgtcacttgtgctaatggtcagttgtacacacatgacatgtggaagtgacctgtagcagcggtcactcattttaacaattgaactctgctgggttgggtatttacctttgtctagaaaagaaatatgatatattttctctaaataaatttattttcatcattccatatggcatt

SEQ ID NO: 325268 - DNA, 381 bp, Homo sapiens
tttgccaggaatcaccattaccaggatggtgtttccacatttatctgactttcttagaagcttccaattgctgtgtatgctttgtgagagaattctgtgcagctgttccccgatgctactggggataattaatcagtgaattagtgacacatttcaggtactgtcatgttctctaaggaatccaggcaataagaattgaggcatggtacctcctttctaggagttgacagtctaattgagaagctgaaatttatacacataagagatataagcaatgattcaaggcagatggaaataagtcatttataagtagagtaggtagtaagttgagaggaggtagagattgtccatgttggtgaaattgatcagggaaggcttcca

SEQ ID NO: 325269 - DNA, 545 bp, Homo sapiens
cacttagtaaattaatgaaagcctattgtgaacagggttaggcaatgaggttgatcagattctagacttcatgtgcaaccaatcaatgaaatagacacacctgtaaagttgaagatggaggctaaagatacaattaatgtgttccaaggacaggaggttttgactaaaaatggagcctgctactttattacagaactctgttcttacggaccaagaatgcattttcaattagaaaactgcgatttggttccatcacaccctgactactacagtatagttttctctatcattttcctcttccccattactttattatatgtatatattagttacaatgtaactatgtaaacaattaaatgtgtaactgcaagatctctaggagtaacagaattctacatcttcatatagtctttatggcatattgtatatgccatagttataatgcataaaagcgttttgcatttttttaaccaaatggtcaattttttttttttttttttttgagacggggtgttgctcttgttgcccaggctggagtgcagtgg

SEQ ID NO: 325270 - DNA, 336 bp, Homo sapiens
aaacttacgcacatatgaaaagtaagatcagacaactcagaagaaaaacgataatccactaaaaactatgtcaacattttcatttagtgctctggctgtaacataggattaaaaatttgaggattgtggttcagtagttaaagcagtaagctttgccaatagtgaggcatcttgagtatttgttgcggaaataaataaatgcctgctaacaatgtgtatatagggatgcaaaataaattctattggtcagtaatttctgaagtctttactccactagtcagtaagtgattttcagtagtgcatctggaaagcttgagtcatacagggaaaaaaaaa

SEQ ID NO: 325271 - DNA, 146 bp, Homo sapiens
cccctgtgtcctcagctcatcacagcatctcggcacctctgccctggggagccagaaagccttcattgcattagtctgttgcatcaggcattacagcaagacagccacctccttaagtcaggctggctcgggggccccagggcctg

SEQ ID NO: 325272 - DNA, 4646 bp, Homo sapiens
tttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggcgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaattatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccgattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaaagtgctggaatttacaggtaggaccaccacacttggtccacttacttataataaacattgatttggtcgtt

SEQ ID NO: 325273 - DNA, 476 bp, Homo sapiens
ctgtatgttctcactatattccagccagcaacaagtttcttgatcaaaagggcaagggggaggatgagtctagtgctaattcttgcctatgggaaggtggttaaaattattgaggaacaggcttatctgcttttcaatatggaattttcgtatgtcacattgaccacacagaaagaagtgaatcttatcacatgttatatctcacttacccttaatttaaagggggcaggatgcttcttaaacaggaaacaaactaaagtatagcaaagtttagttgagaaataaatgactatttcttttaccctagaaaaaggaatagcaacattgcattggctgttttgtcttatttactgctatattcttaatgcctggcacagagccctgcgcagatttagtttctcaatatgtatgagatgaagagctgactgaattcattaatggagattcacggagatttacgtataaattttgtgcct

SEQ ID NO: 325274 - DNA, 386 bp, Homo sapiens
accttgggccacttcagagtatttgtatttttgttgactaagccttctcaccatgcatttgtattatcagcagatttgggaattttccggcgggctgccatggtgttctacacagactgtatccagcagtgtagccgacctctatatatggatagaatggtgttgctggttgtggggaatctggttaactggtccttgtaagtagtcttatgaaaacatgtttttgcctttattaatgtcagtaacactgtggtttagctttccttgactgtcatttttacaaagaaatctgaaattaaggagaaggtaggactgcttgttctagagactcaaaaaaaggtagtaggacattctcgtgtagcaattgtagcctctcttaaaacact

SEQ ID NO: 325275 - DNA, 3523 bp, Homo sapiens
gttcatattttaacatatgaaacatgaaatagaagtataatattatttttgtatccaaatagttaacagagcagatgcccttagattctaatatgtgttcagtcctgaagatagccaagttaaatataaaaacaggagaagaggaaaaataaaagtccattgagaaggaatagagagaaagaacaggtcttgtgaatgagaagttcatttggatcaacacagcatttcctagaatgagtctgcactgtgctttttgcagagacgaatgggctccgtaggctctccacggcttttgatggcagatgagttgtctctgtttcagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccgattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaacactttgggaggctgaggcaggaggatcacttgagcccaggagattgacgccgcagtgaactatgattgtgcccctgcactccagcctggatgacagagtgagaccccatctcttaaaa

SEQ ID NO: 325276 - DNA, 316 bp, Homo sapiens
tcctctttctttctgcccctacccccagggactttctcccttctacctctttcttaccgcctatcataaggttgttatgtcttatgcagaagaaggattttccaggcgagcagttcttcgtggtatttgtgataaagcctgaagattatgcctgtggaggatctttcttcatccagggtaagagctagtgaggaacacttggctgcttagcaaaacctgaaggaagggagtgaaagggaagctgaaacctcctttctagttcccactaaacaagggttggttccatcatcatgatgggaaaggcatctgagagata

SEQ ID NO: 325277 - DNA, 468 bp, Homo sapiens
tctcagagagaaaacaggacttagtgtgacagtgactgtccattcctttcatttctctgtccctctcacttcaggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagact

SEQ ID NO: 325278 - DNA, 680 bp, Homo sapiens
cagccagcaacaagtttcttgatcaaaagggcaagggggaggatgagtctagtgctaattcttgcctatgggaaggtggttaaaattattgaggaacaggcttatctgcttttcaatatggaattttcgtatgtcacattgaccacacagaaagaagtgaatcttatcacatgttatatctcacttacccttaatttaaagggggcaggatgcttcttaaacaggaaacaaactaaagtatagcaaagtttagttgagaaataaatgactatttcttttaccctagaaaaaggaatagcaacattgcattggctgttttgtcttatttactgctatattcttaatgcctggcacagagccctgcgcagatttagtttctcaatatgtatgagatgaagagctgactgaattcattaatggagattcacggagatttacgtataaattttgtgcctaatagtagaggaaacaatcccattcatgtaaatataaatcatgtctttctttttcttattctcagtattttctatacaagtttcccaaagacgtggactcagttatcattaaagtggtgtctgaaatggcttatccatgttctgttgtctcagtccagaatatcatggtgagtgctgataacttgccaaccttctactatagagcattatattattccagaacaa

SEQ ID NO: 325279 - DNA, 4694 bp, Homo sapiens
tttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggcgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaattatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccgattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaacactttgggaggctgaggcaggaggatcacttgagcccaggagattgacgccgcagtgaactatgattgtgcccctgcactccagcctggatgacagagtgagaccccatctcttaaaa

SEQ ID NO: 325280 - DNA, 4015 bp, Homo sapiens
tttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggcgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaattatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccgattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaggaggaccctgccacaaaccaaggtaactttctcctagagcaatgtcaaggtgattctccatgcagatctggaaatgatctggcccagaccttcactctccaccagtagcgtcactcctgctggacttctgctctggttcagtgtgaccgcactgagcttgccctgcctacctggtttgtttcttttgtttcattgctcctcctgtggtcttcgcgacagctgacatgctgacgttattcccacggctttgcttcagccagcaggaggaggacagcagcaggaggagtacagcagcaggagaaggacgggatcctctagaacacta

SEQ ID NO: 325281 - DNA, 315 bp, Homo sapiens
tggaagagaggctgggagccagatatgatttgggaatgcagtgaggggcaatggaggggaatagattcaatacaaccctgcccagtttctctgctgggctgggaaattgatttagggggagctaagcaggagatcctcaaaggccctgcacagtctttggtggtaagttgggcagatttgctatgggtccagctttaaatgcttccaggcactgctctccaggaaagtcacttgggtgaagacactgaatattgatccccagctgccaccgaagttctactatgggctagtgcacatgtcacttaaggaaaagca

SEQ ID NO: 325282 - DNA, 843 bp, Homo sapiens
gtgggcggcccctttcttgagcgcagaaacacttacttttccccctaccctgctcctcctcctccacagccgtctttctctttgcctcagccacttccttccttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaa

SEQ ID NO: 325283 - DNA, 1523 bp, Homo sapiens
  misc_feature (855)..(855): n is a, c, g, or t
  misc_feature (870)..(870): n is a, c, g, or t
  misc_feature (875)..(875): n is a, c, g, or t
  misc_feature (882)..(882): n is a, c, g, or t
gtgggcggcccctttcttgagcgcagaaacacttacttttccccctaccctgctcctcctcctccacagccgtctttctctttgcctcagccacttccttccttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgaggtaaataaaacactttatttgtaaaaaacaaaaaaaaaaacaaaacaaaacaaaancaaaaaaaaaaaaanaaaanaaaaaanaaaaagaaaaaacaaaaaaaaaagaaagaggggcgcgcgcgcgcgcgccacaaaaacacacccaccaccgagggcgcgcgcccacacacgacgcgccgcgccccacgcgtaattttctgataaacaacgaaaggggcgcgcccactcataagaggaggagcgcagctgtatatatatatataacgatacgcgcgagacgagcgagcgggcgcgcggtatattaataacaaaagaagcaatagtgcagggggaaaccaaacgcggcaacctcgcggggatcaatatcttggagagaaaagagaacaacatatctatcgtcgacgggggagggggagggacaaacaagagtaggtgaggaaaaacaaacctccaccccaggaagaataataataaaagcgcagccacggagggagagaaaatcaataaaacaaaattttctaaaggagtggacaataaagtgggtgtaaaaacacaaacaaacgagtagaatcaataatatgctaggggactccatggcgacaaagaaaaaaattgttgcgcgacgaacagcgagggagagatatatatatgttagcaatgaaaaacatatatattttctacaccagaggagagacaagtatgaataaaaaacaagggggggt

SEQ ID NO: 325284 - DNA, 1458 bp, Homo sapiens
  misc_feature (790)..(790): n is a, c, g, or t
  misc_feature (805)..(805): n is a, c, g, or t
  misc_feature (810)..(810): n is a, c, g, or t
  misc_feature (817)..(817): n is a, c, g, or t
gtgggcggcccctttcttgagcgcagaaacacttacttttccccctaccctgctcctcctcctccacagccgtctttctctttgcctcagccacttccttccttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaancaaaaaaaaaaaaanaaaanaaaaaanaaaaagaaaaaacaaaaaaaaaagaaagaggggcgcgcgcgcgcgcgccacaaaaacacacccaccaccgagggcgcgcgcccacacacgacgcgccgcgccccacgcgtaattttctgataaacaacgaaaggggcgcgcccactcataagaggaggagcgcagctgtatatatatatataacgatacgcgcgagacgagcgagcgggcgcgcggtatattaataacaaaagaagcaatagtgcagggggaaaccaaacgcggcaacctcgcggggatcaatatcttggagagaaaagagaacaacatatctatcgtcgacgggggagggggagggacaaacaagagtaggtgaggaaaaacaaacctccaccccaggaagaataataataaaagcgcagccacggagggagagaaaatcaataaaacaaaattttctaaaggagtggacaataaagtgggtgtaaaaacacaaacaaacgagtagaatcaataatatgctaggggactccatggcgacaaagaaaaaaattgttgcgcgacgaacagcgagggagagatatatatatgttagcaatgaaaaacatatatattttctacaccagaggagagacaagtatgaataaaaaacaagggggggt

SEQ ID NO: 325285 - DNA, 786 bp, Homo sapiens
gtgggcggcccctttcttgagcgcagaaacacttacttttccccctaccctgctcctcctcctccacagccgtctttctctttgcctcagccacttccttccttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaa

SEQ ID NO: 325286 - DNA, 1512 bp, Homo sapiens
  misc_feature (844)..(844): n is a, c, g, or t
  misc_feature (859)..(859): n is a, c, g, or t
  misc_feature (864)..(864): n is a, c, g, or t
  misc_feature (871)..(871): n is a, c, g, or t
gtgggcggcccctttcttgagcgcagaaacacttacttttccccctaccctgctcctcctcctccacagccgtctttctctttgcctcagccacttccttccttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaancaaaaaaaaaaaaanaaaanaaaaaanaaaaagaaaaaacaaaaaaaaaagaaagaggggcgcgcgcgcgcgcgccacaaaaacacacccaccaccgagggcgcgcgcccacacacgacgcgccgcgccccacgcgtaattttctgataaacaacgaaaggggcgcgcccactcataagaggaggagcgcagctgtatatatatatataacgatacgcgcgagacgagcgagcgggcgcgcggtatattaataacaaaagaagcaatagtgcagggggaaaccaaacgcggcaacctcgcggggatcaatatcttggagagaaaagagaacaacatatctatcgtcgacgggggagggggagggacaaacaagagtaggtgaggaaaaacaaacctccaccccaggaagaataataataaaagcgcagccacggagggagagaaaatcaataaaacaaaattttctaaaggagtggacaataaagtgggtgtaaaaacacaaacaaacgagtagaatcaataatatgctaggggactccatggcgacaaagaaaaaaattgttgcgcgacgaacagcgagggagagatatatatatgttagcaatgaaaaacatatatattttctacaccagaggagagacaagtatgaataaaaaacaagggggggt

SEQ ID NO: 325287 - DNA, 850 bp, Homo sapiens
gtgggcggcccctttcttgagcgcagaaacacttacttttccccctaccctgctcctcctcctccacagccgtctttctctttgcctcagccacttccttccttcgcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgaggttgatctctcataaataaagagcgattcgcacagaaaacctttcggcccc

SEQ ID NO: 325288 - DNA, 744 bp, Homo sapiens
tcttgatgcagcttttgggctgggcaaggggattttattttatttctttcagaaaacaatcatttctcctttttacttatttgttttctactcattaatttctggctttatcttcataattctccctactttttaaaatgcactttattgttctcattctagtttcttagggtggcacaaagtccctctcgtttattttttcctctaaaaaataagagctgtgctgggggctctgggcgctgcattagctgagtcctcgatatttatggattgatatttatggcttctcggcttttcagagagtgcacgttcagatttaatatcctgttttacccaagggctacctgggagtgtgttggtttctaagtttctgggggaagaggtggcactttccgttatttattttacaattttttggataacaggatcattttaattattctactttttagttccttgaggttttctttgcagccaatacacaacagacatggacttatcggaagtcggaacgtttggaagctctgtttcccgtgaggaatcttcggaagcgctgtttcccatgaggaacgtgagcatgaccatccatattgatctgtctgcatttttctgttgccactagacctaattatggagagagagacacggagggagctcctgtgaccctcaagtcccctcatcatgtccccgtcctgttggctttccgagtttagctcccatgtttggaccatggaggtttatgtc

SEQ ID NO: 325289 - DNA, 791 bp, Homo sapiens
atgtcaataaatataatttgactcatatgcataaaatagtctgtattgccccaaagctttgctgttctgaaggattataaaatcattggttgtaaatattaaccagctcctaatataatctgacatctacttatgaaatttgcaaaaacagttaataatgttagctatgcaagttaacaaatcagtgtaaccaaataacaaactatttttattttgaacaagcattatactgatatgaatgcaaatataagtattcaatgacataggtaaatttttattttgagaattactgttatatttatgtctagtatgtctataattttgttctttatattctgtgtaaatgaggcaacagcgttctgtgtgtgtgtatatatatatacacaaaggatatatatatacaaagaatatgtgtatatatatgtgtgtatatatatatacacaaagaacgtgtgtgtgtgtgtatatatatatatatatatatacatacatacacaaaggatatatatgtacatgttattgatagaaacaatcagaaaaggaacaataaaataaagaagcctgtgttaggaaaatcagtttaataacacaaaggcaaaataggctcagattttttaagtgagatgctgagtcagataattaaacaaggctgttaatatccaggtttttaacccaaggaagccaaataattttcagagttaagtctccattcaagtggcaaaatgaaatatatgaaatattgatgtccatcaatccagggcaaaggtccttggatataaatcgttggcagg

SEQ ID NO: 325290 - DNA, 673 bp, Homo sapiens
gatcaaaaccatgaagaagctccatctaaaagaaagttcctctcttaacttccatcttagagctctcatctaaaagaacataacatttgtaggcactgaagagtataatttttgtaagagtgaaataattaatgttgtatatagcaagtctagcttctttttagttcagtcttctatagcatgctaagaggaaaaaaagtcagactacaaggatttaataattctatgaaatgtcttatattttccaaaaatggcttttgaatagattgttcattgagtctagcagaacatacatataaccaaaagtggtatctctgttactatgttaggtattttgacagttaattttagatgtgaacttgactgaattaaggaatacctagagaagtggtaaagcaattacttctgggtgtgccagaggaaactggcacatgtgccagtgaaccaggtggggaagattcactctcactgtgggcaagtaccatccaattggccggaggcccagacagaacaaaaaatgagagaaagggatttcctctctctcctggagctgggacactcttctccttctgcccttggacatcagaactccaggctctttggctatgggactctgcaccttataccagcagtccctcagatcttctcaaggctttggcctgggactaagaat

SEQ ID NO: 325291 - DNA, 1770 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcag

SEQ ID NO: 325292 - DNA, 1345 bp, Homo sapiens
caacttcttcctgaatgatgtttatgctaccttgaaatttgtcagtatggctttattgaaggataaaaagtatattatattgggaaaggattccaccaatataattgtaaaaggatcgtatcctttttcttcacaaggttccctccagctttaggcataatcactaatgattaagtactagggactttgaaaataaaagagacggcatagaaatgtcttactggaacaaaaaggattcagtagcgtgtgaggctcagctttgtcagtccctggatatgtgatcttggaaagtcatatttgaccttttttaacctataaaagcagcacttttatatagctcagccgtatactttatcatgtaaacctcttggttttcttgttataaatctcatccacagaattaccattcaaattaaatatttaattttaaaaccgactagcacaggctctggcacataataatgtttcttctcatgtttaattcccttagtctctgctaaattctgttcatggaaggcagataccagactactcttcttttcttttttaattttcctattcttagtgcttatcaaagggcctgataggaacagagtatgtgttcagtatatgtatgttccttacaaatatgtattcaaatgaaaggggaaaatgatggaaaattaagatttttttttcgtgaaacctctattccatttgttgcattgacctgcgaataattctagcaataagtactcatcacttgacttttttttttttttaattttgagatggagtctccctctgtcacccaggctggagtgtgccaatctcgggttgctgcaacctctgcctcatggattcaagcaattcttatgcctcagcctcccaggtagctgggattacaggcttgtgccaccacgcccggctaatttttgtatttttagtagagatggagtttcaccatgttggccaggctggtctcaaactcctgacctcaagtgatccgcctgcctcagcctcctgaagtgctgggattacagggcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcag

SEQ ID NO: 325293 - DNA, 1495 bp, Homo sapiens
tggttaaatatttctgggattgacctcattttgataagctttggtgagggtataagcattcagacagagttgatgatactcaacttcttttttctagacaggcagttttttaactactagtaccacttaggaaaactgatgctaaaagtccctaacaaaggcctggttttagtaatcagaaacagtttcagaacctgtttagtaatcagaaacagtagaataaactaaaggattttttttccttccctttttctttgataatcaactttatttattttgaggcggtgcagcatagtgtataagagccaaggtttatctacccattgcaggctctactgtacctctcatttgctgggtgatcttgagcagtttatcctctgtctcagtactatctgctactggtaaaaattaggatactaattatatttactagggtcgttgcaaggattattaagtgaaataacagggagtgtttacaatagggtatggtaaagaataacctctcgtaaaaggatagcttgttattttcttgtcattttctacttttttctgtcttttaaaggtcttggacattttatttacatagaattatagccagaaagatcaactcaattataaattctgggtttgtttttttttaacctataacccttttaactgagactttagttcttatacttcttggttatcaccctttccattagcttttagttaagagagaggttgtaaactcagtgtcaatgctatttttcaaaaattgttaaaatttcatcaatgaagttttgggattattataagttcttgtgtcttaaggccatctgcttttatatccagtgatgtgggattttaatcagccattaattaggtaagcattcactttgaggacaatattctgttttatcttgggtagcatggacagtttgtcacagaaataagttccctattcaaacttggaattagctgattcagagtaacatattaataatataaaaatggccatacccttttatggcgtaacattatttctaggtattgtttctaaggaaataattttaaatattgggaaaaaatatttttacaatttacagtctgtctgacatttggtaaatagctaattgtgatatattcatattaggagatagggtgcagccactaaaatgattttgagtattgttcattagtaatggtaattttcttttatacaattttataaaatttttgctcttatgtactgacttttctggtttataaaaatactttattaaaaagtgagagtttccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgtgacctaaagaattaatgaccattcagaaataaagcaaaaagcag

SEQ ID NO: 325294 - DNA, 560 bp, Homo sapiens
atctgcggtgaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgtacgttgtctctgttacttaaccagtgattgagaaattgttcatgcatggaattaagtgtatgtacttggagcagataaatgccttgtcttctcctggagacaaatgatttaagtgatttttattttttctttagaggaaatttttatcttattttttaaaatgtgtattattgatttccataggtttttgggaaaccggtggtgattagttacatgaataagtt

SEQ ID NO: 325295 - DNA, 308 bp, Homo sapiens
ggaggctcctcagattgccaaccctagatgtgagtcagctcctggatgtggtgtctggcagcgacctgtgattgacaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcag

SEQ ID NO: 325296 - DNA, 410 bp, Homo sapiens
agacagatacgaatcgagctcggtaccgacagcatcctaactggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcagctgccttcgtaaggcacctcggtctggcattcggaaaaccaccccatcttgccagagtcccttggtccttggttagcaaaagccgtatccgatctaaatcatgctttcaatcatgagagaccacattccttctttttcctttctaatatctccagcaggtaacacaggg

SEQ ID NO: 325297 - DNA, 2076 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaaaaaaacaacaaaaaacaacacaacaaaaaacacacaacacacaacaacaaacaacaaacaccacatcccaccacacgcaccacaacacacccacgcc

SEQ ID NO: 325298 - DNA, 2280 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagaaaaaaaaaaagaaaaaaaaaaaaaaaaaaaaaaaaagaaaaaaaaaaaaaaagaaaaaaagaaagaaacaagaaaagaaagaaggggggcggcagagtagagaataagaatgacacacaaggaaaagagcgcgacgcgacagatgagggagacgcagccggggagagtcagaggaggacggaggggggtggtcatccaaacagaagagagggatggtagatatcaaacgagaaggagagcgaggcgggcgtcgacggtgacaaagagctgacgagaggaggcgagcacagggcgcgaggagg

SEQ ID NO: 325299 - DNA, 1940 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325300 - DNA, 1841 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggcgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325301 - DNA, 2063 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagcatcctgttctcctgatgtggttcctccttagtgtttgcctggagccaatctggcttctgcctggactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325302 - DNA, 1964 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325303 - DNA, 1479 bp, Homo sapiens
ggaggaaaatctgaggctctgattacacaccatgtgattcagaaagagacagaggaacgggatgtttctaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325304 - DNA, 1899 bp, Homo sapiens
gttagcctcgtgttaactcatctgcaaaatgggaggagaggggggaggccagattattactaatacgttctgattcttgagataattttgtttactcgtcagaaatatttatccccttggcattttaatttgtttttctttatcactgcctcctttcctcctccggagattcagagaatctctgaagcttaatggtttgaggtaattaatacatctgatatgatcaggtgatcagcctgtaacagtagtgtgtagtcactgcacacactgcagttatagaaaaaacatgttctgtttaatccacctgtcaagatgaatagcacaaatcaaggaagtaatgtggaatatagttttatagtgctttcttgttgttgtgttggagatccaacttagtgggagaatggtggaaaaataagaatcggtcaacagtttcttcaagttcactctggtgtacttgaaagcagtgaaatctgtggccaatattgaaatatacatcgaataaaattttctgttctctttccagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325305 - DNA, 1917 bp, Homo sapiens
tatattagaaagtaaaataaacttaaaatgttaattgattaaaaataactatatgttcatgaaaataacagtttttatggatctctgatgtatggtttaatagaagatagctggattctcacatctgtttctgcattcagtctgctgagagaccacatgtcattgtagcctttgggagaccccaccatatacttctgagagaatgcctgggaaaggcaaatagcatcttagtaatattatggcaatagtttgacctcgctgaccccctggaagttttcagaaatcccatccacactttacagacttgtaggaagaataccacttgggtcaaatatgttggtaacatcataaaatgtattcttttttggcttttccctgacattgcctcagtggatggtaaatgctgggagacacgcatttgatggagcaaaaattataaaccttgcagatactcttcgggtggttggttagctgatacgagttctaatgagatgactattaaattgattgtagattgattgctcttgcttttctgcttcttggtattttatctgcacagatctactctaatcttaatgtagtttatcccaggcaatcacatgataatctgggttaaatgcattttgtctgtataatggaaaggattatattgctttggggagattttattttggtgatattcatcctaaatggtgttctttggttctttccttgctaaaacttcttctgaatctctgtttctttgcttcgctagtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325306 - DNA, 1269 bp, Homo sapiens
  misc_feature (82)..(82): n is a, c, g, or t
  misc_feature (100)..(100): n is a, c, g, or t
gctgcagtcgatctagagatccccgaccaatgttcaccgtcggaatggatatggatttataaatcgaaatgacaccaaagangatgtatttgtacatcanactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325307 - DNA, 1939 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaaagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325308 - DNA, 2006 bp, Homo sapiens
caacttcttcctgaatgatgtttatgctaccttgaaatttgtcagtatggctttattgaaggataaaaagtatattatattgggaaaggattccaccaatataattgtaaaaggatcgtatcctttttcttcacaaggttccctccagctttaggcataatcactaatgattaagtactagggactttgaaaataaaagagacggcatagaaatgtcttactggaacaaaaaggattcagtagcgtgtgaggctcagctttgtcagtccctggatatgtgatcttggaaagtcatatttgaccttttttaacctataaaagcagcacttttatatagctcagccgtatactttatcatgtaaacctcttggttttcttgttataaatctcatccacagaattaccattcaaattaaatatttaattttaaaaccgactagcacaggctctggcacataataatgtttcttctcatgtttaattcccttagtctctgctaaattctgttcatggaaggcagataccagactactcttcttttcttttttaattttcctattcttagtgcttatcaaagggcctgataggaacagagtatgtgttcagtatatgtatgttccttacaaatatgtattcaaatgaaaggggaaaatgatggaaaattaagatttttttttcgtgaaacctctattccatttgttgcattgacctgcgaataattctagcaataagtactcatcacttgacttttttttttttttaattttgagatggagtctccctctgtcacccaggctggagtgtgccaatctcgggttgctgcaacctctgcctcatggattcaagcaattcttatgcctcagcctcccaggtagctgggattacaggcttgtgccaccacgcccggctaatttttgtatttttagtagagatggagtttcaccatgttggccaggctggtctcaaactcctgacctcaagtgatccgcctgcctcagcctcctgaagtgctgggattacaggggtgagccatcatgcctggccctgatcacttgactttttaatttttaaaaataaataaaaccttattttctggagaagccctgtcctgttggcacctgttctattttcttctgtgttccctacagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325309 - DNA, 1874 bp, Homo sapiens
  misc_feature (1874)..(1874): n is a, c, g, or t
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaaaaaaaaaaaaaaaaactttttgggccgccgggccccgaaaaaattttcaacccctcctgttgggcgcgcggcgggcccccagtattgggtagctttgacacctgtgggcgtaatagagttggtcccctaaggagaaaccctggggtcagagaagaaccggcgttgtggtttcttcccccatataaaaaacccgccgggggggaaccagcgcgttcttgagacaactccaaaagtggggtcacgagaggcaagagggggttatttacacggagtctcaggaggcgaatataattgcgn

SEQ ID NO: 325310 - DNA, 1424 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaaggtgagaggaaattgtggttgggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325311 - DNA, 1305 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325312 - DNA, 1461 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcag

SEQ ID NO: 325313 - DNA, 818 bp, Homo sapiens
cgagctcgtgtacggggatctctagagtcagatgtgcaggctgccgtttgtgtagcggtggttcagctggagaccgtcgatagtaagcggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325314 - DNA, 1484 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtttttaaaaaccatggcccatctcagccaaaatataaaaaaaagggcggccctcgcgatctaaactag

SEQ ID NO: 325315 - DNA, 1491 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggacctaaagaattaatgaccattcttaaagtacactccaggtctgctttctgcgctctacccaacacaccaacaca

SEQ ID NO: 325316 - DNA, 1254 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcag

SEQ ID NO: 325317 - DNA, 2032 bp, Homo sapiens
tggttaaatatttctgggattgacctcattttgataagctttggtgagggtataagcattcagacagagttgatgatactcaacttcttttttctagacaggcagttttttaactactagtaccacttaggaaaactgatgctaaaagtccctaacaaaggcctggttttagtaatcagaaacagtttcagaacctgtttagtaatcagaaacagtagaataaactaaaggattttttttccttccctttttctttgataatcaactttatttattttgaggcggtgcagcatagtgtataagagccaaggtttatctacccattgcaggctctactgtacctctcatttgctgggtgatcttgagcagtttatcctctgtctcagtactatctgctactggtaaaaattaggatactaattatatttactagggtcgttgcaaggattattaagtgaaataacagggagtgtttacaatagggtatggtaaagaataacctctcgtaaaaggatagcttgttattttcttgtcattttctacttttttctgtcttttaaaggtcttggacattttatttacatagaattatagccagaaagatcaactcaattataaattctgggtttgtttttttttaacctataacccttttaactgagactttagttcttatacttcttggttatcaccctttccattagcttttagttaagagagaggttgtaaactcagtgtcaatgctatttttcaaaaattgttaaaatttcatcaatgaagttttgggattattataagttcttgtgtcttaaggccatctgcttttatatccagtgatgtgggattttaatcagccattaattaggtaagcattcactttgaggacaatattctgttttatcttgggtagcatggacagtttgtcacagaaataagttccctattcaaacttggaattagctgattcagagtaacatattaataatataaaaatggccatacccttttatggcgtaacattatttctaggtattgtttctaaggaaataattttaaatattgggaaaaaatatttttacaatttacagtctgtctgacatttggtaaatagctaattgtgatatattcatattaggagatagggtgcagccactaaaatgattttgagtattgttcattagtaatggtaattttcttttatacaattttataaaatttttgctcttatgtactgacttttctggtttataaaaatactttattaaaaagtgagagtttccatttaattaacatatagcttacagatctatacaagatgtgattgtatttagagcatttgaagtactctttttctaattatatgaaaagcatataatttctgcctttttattctttaactcatggttactttgtcactctttataagtttgattttaatttttcccaggtgtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325318 - DNA, 683 bp, Homo sapiens
  misc_feature (17)..(17): n is a, c, g, or t
  misc_feature (20)..(20): n is a, c, g, or t
  misc_feature (28)..(28): n is a, c, g, or t
  misc_feature (86)..(86): n is a, c, g, or t
ttatattattatgtttnttntgtttttnttgtaatggggggagaaagggttgaaaaaacaagagggaaaggttggtaggagtacgnggaatcaaagacttgtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325319 - DNA, 653 bp, Homo sapiens
  misc_feature (44)..(44): n is a, c, g, or t
  misc_feature (48)..(49): n is a, c, g, or t
  misc_feature (70)..(70): n is a, c, g, or t
tgaaagttattagtgtgttacacaatatgttaaaaacaaaaaanaaanncccttattgtgtaaatcaggngtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325320 - DNA, 640 bp, Homo sapiens
cgaatctcccaatagccaaatcacaacacagacaaaacccactccaccttataacgggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325321 - DNA, 922 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatctggggaggaggactttccccttttctgataaccccctccttggtgataggcattgcccctgctcatgttgaattcccctttttttc

SEQ ID NO: 325322 - DNA, 889 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcaggtaagagggattataaatactacatttgctatgtgaggagagggtgtgtaatcttctgtcagccctttcccaaaagtaagtcctatggattattattttaatctaaactctttctgtgatttattttgcaacaggagttcagttccacattttaagattggcaaataagttcttctaccccatcatattaactgttttcaaatagttttatttttgcagttgtataaagtgatatttggttagaccactttctaatttttaaagcct

SEQ ID NO: 325323 - DNA, 871 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcggtgagtcaggccagggagggcaggggctgccgtagtggggcgggcccagccggccgcggagcacgtgtgggcagctcgcgctacatctcccacccgggctggagacgctgacagcacagggtccccagggatctccgggtccccaggggtctccgggtccccagcgctggccgcctcccttgccggcgctcccaggtgagcgcgctgcgccctgcgctcctggcggccgtgtgcatctcccttctggttccgggccagaaagtttaggtcttaacttctgtctcccagacgggcactgttgcggattcgcgtggtggaaaatgcctgcgtttggagaagaaaggaga

SEQ ID NO: 325324 - DNA, 428 bp, Homo sapiens
  misc_feature (57)..(57): n is a, c, g, or t
ggtaaccgagctcggataccatcagtcaacggaccgccagtgtaggtggtaattcgnacggtaaggagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325325 - DNA, 1998 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325326 - DNA, 1977 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcag

SEQ ID NO: 325327 - DNA, 1791 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325328 - DNA, 2672 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatatctctgatgtatggtttaatagaagatagctggattctcacatctgtttctgcattcagtctgctgagagaccacatgtcattgtagcctttgggagaccccaccatatacttctgagagaatgcctgggaaaggcaaatagcatcttagtaatattatggcaatagtttgacctcgctgaccccctggaagttttcagaaatcccatccacactttacagacttgtaggaagaataccacttgggtcaaatatgttggtaacatcataaaatgtattcttttttggcttttccctgacattgcctcagtggatggtaaatgctgggagacacgcatttgatggagcaaaaattataaaccttgcagatactcttcgggtggttggttagctgatacgagttctaatgagatgactattaaattgattgtagattgattgctcttgcttttctgcttcttggtattttatctgcacagatctactctaatcttaatgtagtttatcccaggcaatcacatgataatctgggttaaatgcattttgtctgtataatggaaaggattatattgctttggggagattttattttggtgatattcatcctaaatggtgttctttggttctttccttgctaaaacttcttctgaatctctgtttctttgcttcgctagtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325329 - DNA, 1634 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggcgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325330 - DNA, 1497 bp, Homo sapiens
atctgcggtgaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325331 - DNA, 1998 bp, Homo sapiens
  misc_feature (604)..(604): n is a, c, g, or t
  misc_feature (622)..(622): n is a, c, g, or t
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagangatgtatttgtacatcanactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325332 - DNA, 1726 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggagggatgctgtcggtaccgagctcgattctaatcatgcaa

SEQ ID NO: 325333 - DNA, 1237 bp, Homo sapiens
ttgggctgcgtggagaatacttttgcgaggcctactggagacttggattcgaagcccagttgggccgaccagtgtacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325334 - DNA, 2041 bp, Homo sapiens
  misc_feature (1425)..(1425): n is a, c, g, or t
  misc_feature (1434)..(1434): n is a, c, g, or t
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggacctaaaanggaaaaaanttttttaaaaaaccttggaaccccgtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325335 - DNA, 1692 bp, Homo sapiens
  misc_feature (1679)..(1679): n is a, c, g, or t
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagcgtcgccccagacccataggttcctactctcatgcctgactantaggagactcccc

SEQ ID NO: 325336 - DNA, 1591 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaatgctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325337 - DNA, 824 bp, Homo sapiens
agacagatacgaatcgagctcggtaccgacagcatcctaactggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325338 - DNA, 1112 bp, Homo sapiens
attcccgacactcccagccccacggtcagcgtcatcaccatcaccagtgacacagacgaggaggaggaacagatacacgcccccaccaagcactgtctccaagcaaaaggaaaaaacgtcatcagctgtgtcgcaagtccacgactccccctactccgactcctccagcaacaccagcccctactccgtgcagcagcgtgctgggcacaaacaatgccaatgcctttgacaccaaggggagcactggagaatcactgcacggggaacccccgaaccatcatcgtgccacccctgaaaacccaggccagcgaagtattgctggagtgtgatagcctggtgccagtcaaacaaccagtcaccactcggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325339 - DNA, 815 bp, Homo sapiens
cgttagacacgggcggcagacaaacgacgggcccgtgagaagccacaaggtaccaaaagtactatgccaaacacttataactggtataaaaattccacatccccatatgggccacctcaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccacaaccttaaccaacaccaaagaaacatccaagcaataaagtggaagactaaccaagatttggacattggaatgtttactgttattctttaagaaacaactacaaaaagaaaatgtcaacaaatttttccagcaagctgagaacctgggaattcctgcacggaagacaagagagtagcctctccagtttcagcaaccgctaggtttctattttttttcctggtttttactgttttggtaatatatatattgaaacaagaaatattaataccacatggggagaaccccaaccaaagaaatctgaaatatatagtaaatgcttttttttccgtttttgttcattttggatgctggtgctaaacctccaagtgtcatgatttaaaaaaaaaaaaaatttatgtccttcttatttatttctaggatgaggggaggataacatttttgctttcttatgtgactctctttgaaaatgtgcagtaagaaattcctcaaaaataaaatttttacccttcagagggacagaatgtttaaaaaa

SEQ ID NO: 325340 - DNA, 1380 bp, Homo sapiens
  misc_feature (1259)..(1259): n is a, c, g, or t
  misc_feature (1302)..(1302): n is a, c, g, or t
  misc_feature (1337)..(1337): n is a, c, g, or t
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagacatctctctcagccgcagaaatgaagacatctttcaccagccgcatggctctgtccaaggacagcggaacatgctccacattctgcatgttcttaaaaccaacctggttgtcaagcangggctgtagcatggcacttgctgagcctccagccttgaaggantctctctggtaagaccctactggatcaaagctgtntacagccccctttccttcttcatcaattcaccgatgatttttt

SEQ ID NO: 325341 - DNA, 965 bp, Homo sapiens
ccgggccggtgcgccgcctagaaaaacttgtgcggggccatttttggggcagtaagatcgagcgaggagcccaagagcgagcgcgcagcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagcatcctgttctcctgatgtggttcctccttagtgtttgcctggagccaatctggcttctgcctggactgccatcaagaagaataacccacggaaatatctgcgcagtgtaggagatggagaaactgtagagtttgatgtggttgaaggagagaagggtgcagaagctgccccagctcggctcgaataaggaggcttagacctgtgcctaggactccagctcatgcgccgaataataggtatagtgttccaatgtggattctgttgatgcggaggaggatggactcggatgtatggtggggcggagcagacacagactatgcagatgggagtgaagacaaggta

SEQ ID NO: 325342 - DNA, 150 bp, Homo sapiens
atggatgtaaggcaagctcctctctgtgcttcagaatagacagggaaataccacgtttatgctgagattttaaatccctttcatttctctgtagactctccatcatgtctgtaaagagaaacttcttctcatagctcaccttctaagaca

SEQ ID NO: 325343 - DNA, 236 bp, Homo sapiens
tcccagctacttgggagactgaggtaggaggatcacttgcccgggaggcagaggtggcagttagtcgagatagtgccactgccactacactccagcctgggcaagagtgagatcctatctttaaaaacaaaaaacaaacaaagcaatgtaggggcctgttactgaggaagaagaaaagaaaggatattgagtaggcaggcacctatcagtgggtagtaggcacaaccagacatggg

SEQ ID NO: 325344 - DNA, 1853 bp, Homo sapiens
  misc_feature (1221)..(1221): n is a, c, g, or t
acttgaatatctgctatatgctgggttctagagctgcaaaagagaacaagagtagtctttacctttaggattttccagggaactgggggagacagacagatacatacacatacaccccatcctcagtgtgtaggtgccatgacaaatcaaggcttttgatgcagatgctatgctttcacttctcatggtcgatactttttgaatcttaaagtctgattgttcagatatctagaaaaggagatgtctggctttgctctgccctctgactcactgtgttggtttatctttaggcgtggtggagggggccagaactactggctaatgagagaaggcagaccttgttagtgacatgtacaaatgggcacatctgctatattcactttcattactgattattaatagtttattaaatggagtttactgaattactattattttggcttaaaatatatatatataatttatgtagttctatgtttatagatgtgttttcagaggtgtatttgttttagaatttcactctgtcctggaagtgatttttcaaatgtggatattaaaatggataggacataatttcccaactagtacagtatgctagtgccaaccttataccactgttgtagtacccatgaaaaataatttttaaaaagctgtaaaagttcccagtgctttgaggcttcttcaaaattgagaatgatgaaaatttccaaaattatcagttgatgccataattatctctaagagatgttgtaataggaaattcatggttttcctttattttcctgtttctgaacacaaaattcaaaagaaaactctttcttccttgtcactgagactcttggtcagtgtaggctgtgaacttgtactttgtgaagagaagagtactgtgaggaagcttgaaaatactgtaggtttttgttggcatcttcttctggatggtattcatgtactctgcacgccactgaaaatatgctctgtttttcataaaatatgctcattcttttatactgagcactcggaaattggttttcccaaaccatcttagtggagaatggcctgcttttatcagttatgtgaagaagtaaattccaggctcctcagctgcaggatggctccttgttcacagctgctgctcttgcctctgtggaagacgcctgctgctaagagaatctttgtgtgttgtgtataaaatgaactttgtttggaccattccacaagcancttaaactgcttaggagtccagccagacattcctccccagttgatcatttaaatggaggtcagatttagaacccaacttatattcgtttaaaaatagacattgcctttagaaaactgacctttggtacatttggggcctagggatctgataggctatctcttatgatgcacatcgctctgttttagactctgaaaggcagtatgcctttgaagctagataacgtcagtgtgcttgtaacttgggacccagtctgtgtgctatatgtctgcttcttcagtccacactcattacttccaggaaattcgtgagaagatgagagattattcgttatagaattgagtatggtttctctacactaattttattggatattttccagtttgactaggaaaggttagagaacatggaaagaaaatttaacaggttaattttaaggtaataagaccattgtattgatatattcttcagtgtgatttaggtgagtcaggaatttttcctctggagactgcataaatcagggatgtccaatcttttggcttccctgggccatactggaagaataagaattgtctcaggccacgcataaagtacactaacactaatgatagctgattagcttaaaaaaaaaaaa

SEQ ID NO: 325345 - DNA, 1481 bp, Homo sapiens
ctgctcattctgggggtgcggttgacggctggtcgtgatctttcccgtaatctgtcccctcttacggaacctagtctccgttctgtccatggccttcttctggacacttctaggatccagaagagtatgttatcaattctcaagcctaggagaagtcaggagtagagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctattccctgtcccagcagaggctgtgtcctctccactcaaagcctgaagcatgttggggtctcttcgtctctgtacatgcccatttcagagtccagtctggtgggagagggaacagagtgggaaagaaaactagggtaagcagaaacgatgaaaccttataagagtgagagtatcatgtacaagagtgagattatcatgtacaagagtgagattatcacgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaaaatcataggaaactgcccctgagctcacacatatttccaatggtgtccccagtttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagactaagtcaaaaaatttcagctgtgcacagtggctcatgcttatgcctgtaatcccagcactttgggaggccaaagtgggtggatcacttgaggtcaggagtttgagaccagcctggacaacatggtgaaaccccatctctactaaaaatacaaaaaaaaaaaagaaaaaaaaaactttttgggcgggacttgggccccggaaaaggttttcaaaaccatcaccattaggaggcagcgagcccatgaagtgaacgggacactggacaacagagcagagaccaccgagagaagacccgggggcaaagagacgaggagcgagaggaaatcaccaccacaatgagaaaacgcccgcggggggcaaccagaagctgtctgtgacaaagatcccagagaggaggaaccagagggacaaaagggagactcactccaggggggaacccaaaggagcccggaacacaagt

SEQ ID NO: 325346 - DNA, 1770 bp, Homo sapiens
  misc_feature (1669)..(1669): n is a, c, g, or t
  misc_feature (1671)..(1671): n is a, c, g, or t
  misc_feature (1680)..(1681): n is a, c, g, or t
  misc_feature (1739)..(1739): n is a, c, g, or t
ctgctcattctgggggtgcggttgacggctggtcgtgatctttcccgtaatctgtcccctcttacggaacctagtctccgttctgtccatggccttcttctggacacttctaggatccagaagagtatgttatcaattctcaagcctaggagaagtcaggagtagagaacagctctgagaagatactgttgtccaactgatctccaggcaccacggagtccggtccctccaatcaggaaggtcggaatctctgatgtcatcgttcatgccaacctggcaaccagtttgaaaaaaaacacatgtaactgccaggctgatctcttgtcctggagatcctgggtgaatggtatctcctgccactgtcccaacctcagaccattgtccaaaagcatcttcagggactccacatccctctattccctgtcccagcagaggctgtgtcctctccactcaaagcctgaagcatgttggggtctcttcgtctctgtacatgcccatttcagagtccagtctggtgggagagggaacagagtgggaaagaaaactagggtaagcagaaacgatgaaaccttataagagtgagagtatcatgtacaagagtgagattatcatgtacaagagtgagattatcacgtacaagagatcccaggaatactgacttgatgaaaaagtcacatcagagcactcagtttggcagagcttttctgccgaatgtttactcacattcactgtccgagattctatactgggggtacacacgtcctctgccctaaggcaattttgagtccaagagacattttgaggcctaaaaatcataggaaactgcccctgagctcacacatatttccaatggtgtccccagtttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagactaagtcaaaaaatttcagctgtgcacagtggctcatgcttatgcctgtaatcccagcactttgggaggccaaagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatggcaccattgtgctccagcctgggcaacaagagcaaaactccatctcaaaaaaaataaagaacctgcgagtgagttcccacacgttttcctaatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatagtttgctctctctctcctagttaacaggctttcaaatattagaagatcaatgttctgaccccattaaaatttctcttttgtggaatgaaaagctctgatttaacccatcttcaagctgncnttgatgagnnatagggctgagtcacctgcatttccctcactgcacaaagtcctggcacagatctggtnctgtctctgctgaggtggtgaccagaagcac

SEQ ID NO: 325347 - DNA, 804 bp, Homo sapiens
  misc_feature (703)..(703): n is a, c, g, or t
  misc_feature (705)..(705): n is a, c, g, or t
  misc_feature (714)..(715): n is a, c, g, or t
  misc_feature (773)..(773): n is a, c, g, or t
aactcttaactattgttatccatatcctacagatgatacagaagtttaaagctacttcttttgtaagccctaaaataattttgggctgggtgtggatgcctgtaatcccagcactttgggaggccaaagtgggtggatcacttgaggtcaggagtttgagaccagcctggacaacatggtgaaaccccatctctactaaaaatacaaaaaattagccaggcatggtggtggatgcctgtaatcgcagctactcaggagagggcgctggagaatcacttgaactcatggtgcgcaggttgcagggagccaagatggcaccattgtgctccagcctgggcaacaagagcaaaactccatctcaaaaaaaataaagaacctgcgagtgagttcccacacgttttcctaatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatagtttgctctctctctcctagttaacaggctttcaaatattagaagatcaatgttctgaccccattaaaatttctcttttgtggaatgaaaagctctgatttaacccatcttcaagctgncnttgatgagnnatagggctgagtcacctgcatttccctcactgcacaaagtcctggcacagatctggtnctgtctctgctgaggtggtgaccagaagcac

SEQ ID NO: 325348 - DNA, 492 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggtgagtggggcgcggcgcggggcttcggggcgggcccgaggggaagctgcagggcgggctagcgcccccctcacgcgacacagacttgaaacttggcgctgttggcacatccggagccccggccgtcggctcgcgtcttccccttgaggggtcggggagtttttgccttctttagacttcagcgggctgccccggaggccactctctgacaagggaggggacgggggcccagagaggttaggtgacttgcccaaggtcgcacagcactgcggctcggggacacgccgggacccccattccccgacggggcggctgc

SEQ ID NO: 325349 - DNA, 1358 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325350 - DNA, 2099 bp, Homo sapiens
gtggtgtgtgcctgtactcccagcactttaggaggccagggtgggtggattgcttgagcccaggagtttgagaccagcctggggagcatagggagaccccgtcgctacaaaaagtataaaactcagccaggtgtggtggtgcaagcctgtagtcccagctatttgggaggctaaggtggtaggatcgcttgagcctgggaggtggaggctgcagtgagttgaaattgtaccactatactccagcttgggtgacagagtgagagactgtctcaaaaaataaaaaagaggggatgtgatttcagagccatccatccactattcctgtgtaatctgattctctttacaatggtaaaattgttaagagtctcacactctttagtaaagaactgtgatagctgggtgtggtgggtcatgcctgtaatcccagcactttgggaggccaaggcaggaagattgcttgagcccaggagttcaagaccagcctgggcaacatagtgaggccctgtgtctttaaaaaacaaacaaacaaacaaaaaactataataaaggatttttgcatctcatttcataggttactatgacatccgatttcataggttaaaaaaaccaccgcgcagaaccgcatcgttttctctgcattgttctgaatgaccgtggctgctgcctttttctttgagcctctctgtccactaacacactccccacacactagcgtgctgcccacgcagagcccactttggctctctccacatctttagtttttccatcctcactaatttacatcactattttattttttttttaattaaacagggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325351 - DNA, 1384 bp, Homo sapiens
gcgaccgccaatgcgatgccgctgctcgtcgatgtacgagagatgctgagccgagatccagttgctgcctctgagcattgatgcgtctttcctgttgaggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325352 - DNA, 1292 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325353 - DNA, 2124 bp, Homo sapiens
gtggtgtgtgcctgtactcccagcactttaggaggccagggtgggtggattgcttgagcccaggagtttgagaccagcctggggagcatagggagaccccgtcgctacaaaaagtataaaactcagccaggtgtggtggtgcaagcctgtagtcccagctatttgggaggctaaggtggtaggatcgcttgagcctgggaggtggaggctgcagtgagttgaaattgtaccactatactccagcttgggtgacagagtgagagactgtctcaaaaaataaaaaagaggggatgtgatttcagagccatccatccactattcctgtgtaatctgattctctttacaatggtaaaattgttaagagtctcacactctttagtaaagaactgtgatagctgggtgtggtgggtcatgcctgtaatcccagcactttgggaggccaaggcaggaagattgcttgagcccaggagttcaagaccagcctgggcaacatagtgaggccctgtgtctttaaaaaacaaacaaacaaacaaaaaactataataaaggatttttgcatctcatttcataggttactatgacatccgatttcataggttaaaaaaaccaccgcgcagaaccgcatcgttttctctgcattgttctgaatgaccgtggctgctgcctttttctttgagcctctctgtccactaacacactccccacacactagcgtgctgcccacgcagagcccactttggctctctccacatctttagtttttccatcctcactaatttacatcactattttattttttttttaattaaacagggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggtgagatctacgctgctctcataaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325354 - DNA, 1383 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggtgagatctacgctgctctcataaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325355 - DNA, 2025 bp, Homo sapiens
gtggtgtgtgcctgtactcccagcactttaggaggccagggtgggtggattgcttgagcccaggagtttgagaccagcctggggagcatagggagaccccgtcgctacaaaaagtataaaactcagccaggtgtggtggtgcaagcctgtagtcccagctatttgggaggctaaggtggtaggatcgcttgagcctgggaggtggaggctgcagtgagttgaaattgtaccactatactccagcttgggtgacagagtgagagactgtctcaaaaaataaaaaagaggggatgtgatttcagagccatccatccactattcctgtgtaatctgattctctttacaatggtaaaattgttaagagtctcacactctttagtaaagaactgtgatagctgggtgtggtgggtcatgcctgtaatcccagcactttgggaggccaaggcaggaagattgcttgagcccaggagttcaagaccagcctgggcaacatagtgaggccctgtgtctttaaaaaacaaacaaacaaacaaaaaactataataaaggatttttgcatctcatttcataggttactatgacatccgatttcataggttaaaaaaaccaccgcgcagaaccgcatcgttttctctgcattgttctgaatgaccgtggctgctgcctttttctttgagcctctctgtccactaacacactccccacacactagcgtgctgcccacgcagagcccactttggctctctccacatctttagtttttccatcctcactaatttacatcactattttattttttttttaattaaacagggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325356 - DNA, 1537 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggtgagtggggcgcggcgcggggcttcggggcgggcccgaggggaagctgcagggcgggctagcgcccccctcacgcgacacagacttgaaacttggcgctgttggcacatccggagccccggccgtcggctcgcgtcttccccttgaggggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325357 - DNA, 1461 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325358 - DNA, 1611 bp, Homo sapiens
acgcgcggcccgaggggcgggggcggcgggcggcccggggctgcaaagcggggggccgccgcctccctgggcctgcctgggcggccgcctccgcgatgccgctgctcgtcgaggggcggcgagtgcggctgccgcagtcagccggggacctcgtccgagcccacccgcctttggaggtgagtggggcgcggcgcggggcttcggggcgggcccgaggggaagctgcagggcgggctagcgcccccctcacgcgacacagacttgaaacttggcgctgttggcacatccggagccccggccgtcggctcgcgtcttccccttgaggggaaagagccagacttctcagaggtcagtctgttcaacaagtgggaccccagggccttctgtatgttcagcaaagagagcttgcagtgacctccccaaaggatggctccatctccattctgggttctgatgatgccactacttgtcacattgtggtcctgaggcacacaggtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325359 - DNA, 1222 bp, Homo sapiens
ggagggacatgcttcctgagtctcacgcgcgtcttttgggtgaccgctcccttctggggttctgatggtgccactacgtgtaacattgtggtcatgatgcacacgtgtaatggggccacctgcttgacacattgtgacggaaccgacaccaaagctgaggtccccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325360 - DNA, 1255 bp, Homo sapiens
tagcgaactttagcaggaggaccaatgattagcatttatgatgcagagacagaacaacttcgtataggaccgtactcctggacaccatttccacatgtgaatttctggttgcaccaagatgacaagcaaatactagagaatctttccacttcgcctctggctgagccaccccactttgttgaacatattagatctaccttgatcatgaactccataaaatccttttctgaccacgctcaatgtggaaggctggaagtacaccttgttggaggcttcagtgacgacaggcagttgtcacaaaaactcactcatcaacttcttagtgaatttgacaggcaagaagatgacattcacttagtgacattatgtgtgacagaattaaatgaccgggaagaaaacgaaaaccactttccagtaatatatggcattgctgtcaacattaagactgcagagatttacagagcatcctttcaagatcggggtccggaggagcagcttcgtgctgcgcgaactttagcaggaggaccaatgattagcatttatgatgcagagacagaacaacttcgtataggaccgtactcctggacaccatttccacatgtggatttctggttgcaccaagatgacaagcaaatactagagaatctttccacttcgcctctggctgagccaccccactttgttgaacatattagatctaccttgatgtttttaaaaaaacacccatctccagctcacacactgtttcctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggcaaaacaaagcagaaacgaaaaagcctcataagacaactaacaggaggggggcgcgaacacgacaaaaataaccccccagggagagggcggccccagaggttactcgcgtcaccacagggctacttgcgaccaagagtgggcccataaagagaagagcacaataaaaagcaaacacacagtagggacggacgataatacaaaacgcgaggcacacgagaaaaaccgggcaacgagggaacctagagcagagagacgc

SEQ ID NO: 325361 - DNA, 398 bp, Homo sapiens
acaggcaagaagatgacattcacttagtgacattatgtgtgacaggtaagtcctgccatttgccccaaagcaaagatgtgggtctcaggaccgttttgtccccagtcttgcagtgggcccaagcaccggcacacactgctgtcactgcttggccaccatctgttccggctcttcctgtggtgggatggccttccccttccccttgccctcgtccaccatctgccgagcctcagttccagtgcagccccctcgtctcccaggaaggagggcactggatctcagaggagctgccacccgtgtggcagacagggtgcacagagaaggtggggtgggagtggggaccgattctgcagctgccagtttgttcagtataaacccccctgccttgggacagggta

SEQ ID NO: 325362 - DNA, 7978 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagctctggcactggctaaataagaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325363 - DNA, 566 bp, Homo sapiens
aactgaagctattacatgatttggaatcaagtggtcacgtgatttttctgaatcacgatatgacactgtttatttactctttctttttatctttgggcattccagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcagggtaagtaagccacagaatttcttattagtgaatcatccaggcatttccgttttttttttttaaaaggaggatttttttctcctgggggtatacaaaagaactggtagtaggaattttcagtgaaatagccttttgtgtcccacaaatgaaattttcattgaaaatagtattgtttacaaggcatg

SEQ ID NO: 325364 - DNA, 7954 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325365 - DNA, 8380 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaaaaaaaaaaaaaaaaaaaaacagggggggcgcgcgcgcccaaaaattccccccgggggggcgcccaagtgcgccgccccccatttttttgtggaaaaagggggcgccccccataaataggggagagcgcctataatatactaccgcaaggcgacgagggggccgcgcgggtctaaaacacccgtcggcagcggggggaaacacaacgctcgcgacagcggggaaatccgggggaggaaagggaccccatatactcgtggggggggaggaaaatagggtggaaaatatactaaaaggaactataaaagtctcagagggacaattatagatttttagggtgtatcagtggggttaacacaagtggatatagtgctgcgcgaggaaaattgtggctagggatattgattttagatatttttacggggagt

SEQ ID NO: 325366 - DNA, 8118 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaaaaaaaaaaaaaaaaaaaaaaaaaaaaaaaaaaaaaaaaaaaaaaaaaaaaaaccttgtcgcccgcttggcccaagtcaattttaaactcgaccaagttaatccttgcggccgaatttggggctaattggcccaattccccttatagggagccgtttaacatttaattgcccgcggtttaaaaacgtcggaactggaaaacccttggggttcccaaattaaatcgctttgaagaaaatccccttttcgcaagttgccgaattacca

SEQ ID NO: 325367 - DNA, 7914 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325368 - DNA, 7901 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325369 - DNA, 5573 bp, Homo sapiens
gttaaaggtcgtgctctttattccagaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325370 - DNA, 5667 bp, Homo sapiens
ttgctcttctcttttaaggaactgcccagaagttgcacaacacttctacttaaatctcattaaccaaagcgtagtcacgtggtcatgtgtagtttcaggggagtctggggaaacagtcctttggatagatccagcaaaaagatggagttcttgttaatgagaatgagcaacaactagcagactttgaaacaatactcaatgaaaatcttaagaaaaaatagtgactatataatctcattagggctccaaaagattgtaaaaataggatactgttttatggtaatcaactaatcattccgtctttttttcttttaggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325371 - DNA, 5418 bp, Homo sapiens
aaagtatggaagcttatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325372 - DNA, 2297 bp, Homo sapiens
ttaaaattgcaaggtttcttcacacttcttatcaaagagggtgtgaagaaaccttgcaattttaacaataactaagaccagcatgtaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattcctcagagcatctcaaaggactacagggtcctttgagaaacatggcccttgatcaagtttacaactctttgagaagacatccctaatggaaatactgaatggcagatctattactgtggtaccatgtagtgtgtaataaatcttgaagtccagaaagcaagtatatttgctgtttagagctatacttaaggtatagagattcttttccacctgtggtgtgtaaaatcagtattgtgtttaattttgcaggtttttcaaggatcaactaatgtgcaaatacagtggtgatatattgatattacattttaataatgcttttgtatggcactttatagttttcagacaccttttgtaacagccctgtgagacagacaatattatccttattgtacagatgggggggctctggaggctctgaaaagtttttggtgatattcccctaagtttataccacaaaatgatggagccagaatttagttgcagaacttctgactccaagtccagagttctttactagacatctggtttcttactagctttttgctagctttttattttacagtgaaaagtatggaagcaaatcctgataattttggcttattatcaaatatcatttattttttattgcagagacccagcagatgtaactctcattgtagccatcccaaagaaaacccttctttgccctttgcagtgccacttatttaggtaactgaagtgtatttccagtacaatttgattttgaactaagatttgatatagagttgtaattgcttacataactctttgaaaatgtatcatccctgggttctcaggtgaaggaggcaattcaaaagtaaaaaagaatattcgaatacaataaataccctctgttctcacacaaatgctgtttcttagctaacttgctttgacaacctactgatgtaacttctttattaatgtgaaatatttatattttgaaataaaattactagtgttgaatgaa

SEQ ID NO: 325373 - DNA, 3726 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaaaaaaaaaaaaaaaaaaaaaaaaaaaaaaaaaaaaaaaaaaaaaaaaaaaaaacagggggggcgcgcgcgcccaaaaattccccccgggggggcgcccaagtgcgccgccccccatttttttgtggaaaaagggggcgccccccataaataggggagagcgcctataatatactaccgcaaggcgacgagggggccgcgcgggtctaaaacacccgtcggcagcggggggaaacacaacgctcgcgacagcggggaaatccgggggaggaaagggaccccatatactcgtggggggggaggaaaatagggtggaaaatatactaaaaggaactataaaagtctcagagggacaattatagatttttagggtgtatcagtggggttaacacaagtggatatagtgctgcgcgaggaaaattgtggctagggatattgattttagatatttttacggggagt

SEQ ID NO: 325374 - DNA, 3082 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggtgagttaaagcagaataatcataagctgtatttatacattgaactgtcctgtctctgtatttgataagtagcttcatccagacttgtcaggataaaggtatttgagtaccaatgctgtgataaaggttgcagaagacactaagtaaatacaaatcgttggcagagttttgggtttcatataccaagaaaatttaaaacctatattggggccgggagcagtggctcacgcctataatcccagcactttgggagaacaaggcaggtggatcacctgaggtcaggagttcgagcccagcctggccaacatggcgaaaccccatctctactaaaaatacaaaaatcagccaggtgtggtggcacccgcctgtgaacccagctgtttgggaggctgaggcagaagaattgcttgaacccaggaggcggaggctgcagtgagcccagattgtgccactggactctagcctgggcaacagcatata

SEQ ID NO: 325375 - DNA, 371 bp, Homo sapiens
cctaatgagtggctctgtattcccatttcctcatgtggactaatgcggtgtgtggtgtttttcttttccttttcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcaggtcgttatctggttaagtacgatctcgtcttgtctttgaagattgatttttttcttttttt

SEQ ID NO: 325376 - DNA, 7037 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttggccaggctgtaggtggtggctcacatctgtaatcccagcactttggaaggctgaggtgggtggattgcttgagcccagggatttgagatcagcctaggcaacatggcaaaaccccatctctacaaaaaaaaaaaaaaaaaaaaaaaaattagctgggcacggtggtgtggctatagtctgagctactcaggaggctgatgtatgaggatcacctgagtccaggaggtcgaggctgcagtgagccaagatggcgccactgcactccagcctgggtgagagagtgagacactgtcccaaggaaaaaaaaaagtgttggggggtagttcttaagcgttgaagatttcctttttggaaagtatttaaaggtagaaatattaataatttttcctaaaacatctccctaagaagtcactgataattataattagtttaaatttattcttacactacttaagaaaaatttcatttagaaaaggctaccatgagatcttttgactatatggagtagactgcatacagatctctttatttctattatgaatattttagcgattataatcagctattccactgagtattagatttggtcactaagtaactcatgtttttctttagtcaatcattcattcattcactaaaacatttgttgagagttggctaaactctagattctgtgccaggcactgtacagggtgatggagatcactcataagaaggcctcttgctcttagccagatcatatgtaatactaaatttaaattttttgcattaaaaggctaaaaaatcatttgtttttgttaattatatactggttgatttatagatgtaattagcacatattcataagagacaaatatatacaatgagttactatacatatacaaagtgattttagctgtataaagtgatattgcaaaaaactacagctaatgtttcttgctgggtaattattagcataaatatcaggttcttagaggtctttaagagaatactttagagctaccaaaattagcagcagtgatgtaatatcaccctgaaataccaggagcagaggtgccccagagtgcttcacagctatgatcaggaaacttgacctgccccattgctacagcaacggcataaggactaggaaggtccactagctggggaggtcttggaaccctccgagccagaaagaagcattccagcatgattcctcagatgcaatgaggaaggtttacagaattttcacagggcaacagagatcaagtggtatgaaaaggtaggagttttaagctcaagtctcaaagataacctacctttacattctcagtcagaatttgacccagaaagaggaagtttcttcaggaacagaccgtacgttgatgaagtagaagtcatttcagtaaaaacggagtacagaacttggtcataatatcttgcattttatagatttattaaagattagtttcaagttcacattcgctattcagttgtaaaccgaatggatgggaggggagaaaatacaagctctccacacaggtatgctcctctcttttctgagagagaaggcatgggattttcagcataaattccatgttatgtgagtgctgtttgagttctgaagttcctatcaatatctgttcctgcaagtgatctctgtaagaccaccttacatgctggtcttagttattgttaaaattgcaaggtttcttcacaccctctttgataagaagtgtttagctggcagagctttcccttgacttctgagtctagtgtgggttggcccatgacagtgggaagaaatccaacatgttacatggagaccttgtatgtaaacaaactctgtagcctttgaaagtggaactgctttttacagttaaagggctgctaaatggcttgcagatgagatcttctggctcaccttgatcttcacatgaacccattgtgacctatctggatttcctaggacctgtagtttccatttgggttatattagtgcctcaggaatgtgtcactactggtcaagcaatactcagaaattcaggctgtgaggggttagattagaggaaagtaatttaggtgagctatccagagctttcaacctcagggtttataggaaaaaaaaacaaaatacaaaaacccttaggacttctcatactctagccctgaccttgcagtctcctctgaggggcctcctaagacccttaaaataatattacaataggactttgagtgtgcatttcacagtggaaatagcctctggctagcattacttccaaatgctagttccagctaaaaacaagtactttttattagtttcttgtctttcaacattctgccatcaaaatatattcattttattaacttaccgattattgggaacctgcaaaaaaaaaaaaaaaaaaacacacatgctgtctgcagccactgtttggttatttttgatagtttaagagaattataaatcaagttgttctgtctactagagtcagaaattctgtgctagaatgggacttctaaaattaggtggtcctgtcactttctagagaaagacccaaattcataggtttaagtggcttgtctgacatacacatacagccagttagtaacagaattcagaatagaatagagttcttttttttctgtcagtccgttgttctacttctctttccttttcttcatggttgagcagcttttggcaaaatgtgttccatatagcagtagttccaagagatgttaatagatgtaagaaaaaaagtgtgtgtgtgttgggggtgggggattgcatggtcaattaaaatgaaggaatgctgagtttgtttccttactgtaggacttctaagagttttgaacatgctattacacattgtgaatttataaaaggggacaaacactgtttgaccttagactgcactccccttctttattccccccccgcctcttccccgcccaccgggcccccccccccacccccccccctgccctccagtcccccc

SEQ ID NO: 325377 - DNA, 4341 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacttttctaagacagtcacttttcaaggaagagggctttcacttttgagtgtgtagttgagtgagcaggaaaaatgaatcttctacccttctcccacaatgtattatacgctctttaagaaataataaatcataagtataagggtggggtggcttatttgatgttcagttttatattataaccctgggagatacaaagactgaagctcttcctcctcttccttttctcttcacgcttctttacactattgccaaattataaaacttggctgaccacgttgaagtgaaatacttattaagctgctatgaatggtaacagtatgataaaattcatgctgttattaggttttctccttccaggtggttgaagtgaaaaatctcaggtgtagcaatactctgatttgttaaatgtatccgtttcattatttggaactctgccaataagttagttttcagcagaattttgtatttatgtagtattttcccatctcttagcacagtgccttgcacatgactctaaatgaatgcttgttgaattgaattgcaactttaaaaatatctcagatatcacaataaccagcatagtgctttacattttacaaagtccttttgcacatactatttcacaagtacatcacatcagctttcatatagctttatattattttacatcagttttacactgatggagaagctaaggttcagaaaagtgaccaactcaaagtcgtaaagtgtagtaggatttggcctcagatctttgactccgttgtgtgcagattctgctgtattagtgttccttctaaatattgtatgcagttttcccagtgttacgagattggtgttgctatccatttgttgtgaatgaagacttgtcctatagtacatgacagggctgagagtggactgtagttcttagctgaaccctttctactgtttaaaacaatcatcaggcctatcctctgctcccaggggaatgtgggagagaaaagggttcttgccatgttgcctaggctggtcatgaactcctgggcttaagcaatcctctagcttcagcttcccaagtagctgggactacaggcacgtgctactgtgcctggctaattttttaatttttggtagagatgagatcttgccaggtttccccggctggtctctaactcctggcctcaagtaatcctcctgccacagcctccccaaatgctggcattacaggtgtgagccacccatgcctggccttatgcaaccctttaaagcacaaagcacaaaacactgggcctct

SEQ ID NO: 325378 - DNA, 3313 bp, Homo sapiens
cgcccctcgggggcggctgtggcggaggaacgatggccgacggcggcggccctaaggaggcgccaagcctgcggagctctcccgggccggcgccgcgggtcccgcgcgcggtcgggccgagtggcggtggcggggagaccccgcggaccgcggcgctggcgctgcgcttcgacaagcccattaagcaggccttctacaacaccggggccgtgctgttcgtgtgcctgtgctgcggcgccgcggtgctggtctacttcatcctggaggccttcctgcggccgctgctctgggccgtgctatgcggcacttttctgcaccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtggatctggacgttggtggttggctatgtgttgactgtttcattcaagtggaatgcaagcactgaacgctacttgagagcagtttcaattcctgtctggattatattgctttttcatttagcatccctggctggctcatggagaattccagtattcctggttattgttttcctgatgtctgtgggtaccctctatgaaaaacagaatggaaaagagtcttctggggcagagttaccagggcaggttatctccatggcagcttctactctggcaaacttggccatctctatcacagggtatgaatcaagcagtgaagaccagccctccactcagcctgcagaagcagtggacaggggagaatccgctccaacgttgtccacctccccttcaccctcctccccttcacccacttccccttcacctactctgggcagacgaaggcctgaaataggaacgtttcttagaaagaagaaaactagtgacatctactttgtgtctctagtttgggccattgtcgtcatgcagatctggttgaacctgtggattgtgcagttgctgccagtgccgattgcagtctggatactcaaaaagcttgtcattcactttggagttgtggatttcctagagaaacgctaccatgtgtggtggggcattatagaaagcttcctgaaggagcggcagggagctctcgcgccttggcccattgtcgggcttggaaaattcttgttaaaagttgatagcaagatgatcatctggttggagaagatgttagataaaataattagcattttcatcatatttttgttagtgataggaactcttcttttagccctactcctgactgcaaaggtacatcaagagagtgtacacatgattgaagtcacaagtaatttgattaatgaaactctagcaaatcaccctgagtgggcaaattggcttcctgaggctcaggtagtccaaagagccctgaattctgcggctaacaacgtgtatcagtatggacgagaatggataactcacaagctccataaaattctaggagataaggtgaacaatactgctgtaattgaaaagcaagtactagaactttgggacagactgtatcactcttggtttgtaaagaatgtaacacactctggaaggcacaaaggacagaagttgcatgtcagtcgtcagaatagctggctgggagacattctggactggcaggatattgtttcctttgttcacgagaacattgagacatttctttcgatcttggagtctctgtggatcgttatgagccggaatgtgagcctgctgttcaccactgtcactacactcttgaccatcctcttctacagcgggacagcccttctcaattttgtactctctctgataattttcctgaccacactattttatctattaagttccagtgatgagtactacaagccagtgaagtgggtgataagcctgactccactatctcagccaggtccttcttctaatattattggccagtctgtggaagaagctatcagaggggtgtttgatgcttccctcaaaatggctggcttctatggattgtatacctggctgactcatactatgtttggcatcaatattgtcttcataccatcagcattagcagcaatccttggagcagtgccattcctggggacatactgggcagcagtacctgcagttcttgacctgtggctgacacaagggttaggatgcaaggccattttactgttgatttttcatctcttgccaacatactttgtagatactgcaatctactctgacatatcaggaggtggccatccttacctgacaggcttggcagtggccggtggagcatactacctaggcctggaaggagcaatcatcggtcctattcttctctgcatacttgtggttgcttccaatatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccctctgcccttccagctgtgcctagcaagcaaaacccaggaaagaagcagaagcctcctggccttacatacagaatgcctggacaagagagaacttgctgcgggctgctttgtattttaaaacacagcttgagagttcagagttggtggtttgctcacttaactgttgttaagatggcttgaaaagtttcattttatacactggtaccctggcttgaaatttttccactttggttatctatgttactatattatatatttataaagttattttaagaactctaaactacctgctgttaaaagaatagatggtgtaattttttcctggtttaagaaatgtattgttaaacattcttcatatgtgatgtccttagtcactaaggttaaactttcccacccagaaaaggcaacttagataaaatcttagagtactttcatactcttctaagtcctcttccagcctcactttgagtcctccttggggttgataggaattttctcttgctttctcaataaagtctctattcatctcatgtttaatttgtacgcatagaattgctgagaaataaaatgttctgttcaacttaaaaaaaaacca

SEQ ID NO: 325379 - DNA, 433 bp, Homo sapiens
caccccttcaagagctcgctgacgcgcctgggccgccactggctgcagcgcctgcaccgcgcgcacacgcccatcgtcctggccgcgctgctcctgccgctctgcttcgtcgactacggcgtcgaggccctgggcgagcaggcgctgcgccgccgccgcctgctcctgctgctcggcgccggcggcccgctcctgtacggcctctactgcctcggcagctacttgggcgtgcaggtgctgctggtgcacgctgccacgctcatctgccgcgggctggactacttcagcagcctgtgggtgagtgagcggcagtccgcccccgtcccccgcccgtggtcccggcgctctggggtgcaatcctgcagctgttcctcccggtgcaggggcgacgaggggccacacctgtgctgcagtgaccgtccgtctccgcttt

SEQ ID NO: 325380 - DNA, 906 bp, Homo sapiens
accacaccccatgcccatgcaggatgatagtgaatagtggccaaaagatactataattagactcatgtaattaaggaatatttttgtcttgtacctattatgtgcctataaagactatgaaatctatttattcagtgatttattggaataccaaataagcaaagatcctatgtgctaaagattctaatattgtgctaagattttccctcagatgtttggctttctcaaattccctgagggctagaactttgccctactcatttgtgtttcccaagtgtctaacgcagtgcctgacacatacaggatctccaaacgcttgctgaatgtgtgaggaaggaattaaaataatgtaccgccgggcaaagtggctcatgcctataatcccagcactttgagagaccgaggtgggcagatcacttgaggtcaggagcttgagcccagcctggccaacatggtgaaaccccgtctctactaagaatacaaaaattagccgcgagttgtggcaggcgcctgtaatcccagctactcggaaggctgaagtgggagaatcacttgaacctgggaagcagaggtcgtagtgagccgagatcagaccgctgagctccagcctgggtgacagagcaagactccatctcgaaaaataaaagtaaaataaaataatgtactaactggacccagaacagattttccaattgattattgacaacaaaggaatctgaattatctaataaggtgaataagtacatattcatatatatatgtatatgtgtgtgtatttacatttttataaaagtgtaaaagtatatatactttttttcctttcttcaggtagaaacctctcctagattgtcactgaataaacattagcactaactatggcaatcaaatcacatattgattggtgtc

SEQ ID NO: 325381 - DNA, 1863 bp, Homo sapiens
  misc_feature (425)..(425): n is a, c, g, or t
tttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttntttttttttttttgcagcaaccattaataaatgccaccacattctaccagcacaaggaaacataggcagcactgaaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagacttta

SEQ ID NO: 325382 - DNA, 3949 bp, Homo sapiens
  misc_feature (425)..(425): n is a, c, g, or t
tttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttntttttttttttttgcagcaaccattaataaatgccaccacattctaccagcacaaggaaacataggcagcactgaaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggtagtaaaagttgccacagcctaagtttgtttcc

SEQ ID NO: 325383 - DNA, 3874 bp, Homo sapiens
  misc_feature (8)..(8): n is a, c, g, or t
  misc_feature (21)..(21): n is a, c, g, or t
  misc_feature (37)..(37): n is a, c, g, or t
  misc_feature (350)..(350): n is a, c, g, or t
gccctggngctaagccgtccntgtgtgatgaataggntattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttntttttttttttttgcagcaaccattaataaatgccaccacattctaccagcacaaggaaacataggcagcactgaaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggtagtaaaagttgccacagcctaagtttgtttcc

SEQ ID NO: 325384 - DNA, 3276 bp, Homo sapiens
cctgagtgcatgggctgatctcccgcaggaacatggtgatgtcttaagagtaactgggagccacaggagagtcactgaggcctggggctgaagagatgtaagacataggggaggagcaccgtgaggctcgtgagtttgcaggtgattcctgggtctggggggctgactccagctgaaatctggggttgtttggagagtagctgggagacccaggagactcccagagagctgggggtgagctgctgggtgatggcagtaggaacatatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacatttcactcagttgcacttagtcgtatgtcttgcatgcttagtctaaagactgtagcaaaaaaaaaaaaaaagaaaaattagattttacatatctttgcaggtatcacagccttgcagaagaaccaactgaaaaaaaaattctcaggctttacagcaagcaaacttcactatgatttttacaattctgattctgtatcccctgggggttatcccagttgcttctttaggatggggtttattacgttgtacatatatcccgatgtgtctgtgtgaatctttgtcttttttgggggagggcagagggcggttctttttttagatattgttcctaaaaaggaataaatgcatacacctgtttgtcaaaacacctttgctttttgtgcaactgctttatattaacgatactaaaaaaaaatagctttggaaaaaaaactactgtatgtaacggaattgcagaatatgctgcacatgtattttatttagttatccttgctttaagaatattggatgacatttcctgacatgtgggagggagaaactccctaactttttttttctgcttttaaactgtaacatagttgaagatttcttttttctgttctcattgattggagcattttgtacaggttttgtgtgtgtgtgtgtgtgtgtgtgcgcgcgtgcgtgtgtgttaatctgttttttgatacattcctatcccttgtgtttatcctaccactgccttcctggctatcttaaacaagttcatacatttgaaaagaaaaaaaaatgttgtttaaaaaatgttttctcctgctgcagtaaatattttgcatgatgaaattccagggtcacacttttccaagtttatcagtgaagtagtgattaacaatggggagtgtcaaaactattgaacttttgtataaaaaaaaaaaaactttacaaggtgccaagatgtaaagaaaatctgttactttttttttctcaaagaaaagcatacattagggaggtagtcccgtgtgtcagacaaatgcactgtcaggaatgaggatccaacctacctgtccctagagtccgtcttgtaagatgagttaggctgccccttggaccagccacaaaatggaatatcaaggcttatgtacatacgtgaagagttaccaccagtcctgccacctttggacagctctaacaccatccccagcatccagtcagacctagtaaagaaaaccttggattcttaacccaagataggctgtaaatcactagcttttttttcctcatgaaaaaaaatagagttaaaaaatatttcctctcttttccatattccagctgaactccgtttccaaaggcacaaagaagagtgtgcttattcagattttgaatctttttggtaccttttggttaatgacatagcctcctgaaattctggatgtcttcaaagtcagttttgcttctttatcctgaaaatcagatttacaatgctgaaggcatttcttgggcccagtgtagctcacgcaatctctgctacccataagccttgatgaagatgatacagtccggactgtgagcatggtgcttcatgtatatgtgctgccagtaacaagaatttttttgttttgttttgttttgttttgataaggcataaaagaaactcattccttgacatcaactgtaattccatcattccatgtctgcggatacagacaataaaaaaaatgttgtgtagtcagtactaattactgacattataagcattctcaaatgcaataaaaatgctggttgttcacgctggtagtaaaagttgccacagcctaagtttgtttcc

SEQ ID NO: 325385 - DNA, 2329 bp, Homo sapiens
taaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaagtcctaatataatgcaatgtgggtatattattttcaagcttaaaaggacctttcagttttattagtggggaggagtacagagttacaattttgtgctttatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325386 - DNA, 702 bp, Homo sapiens
cccgctcagagccagtttctcccgctcagagccagtttctcccgctcagagccagtttctcccgctcagagccagtttctcccgctcagagccagtttctcccgctcagagccagtttctacacctgcgagattgacgccctcaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcaccctgctgcaggggctctggagagaaacaataaagagattcacacacaa

SEQ ID NO: 325387 - DNA, 1956 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325388 - DNA, 1286 bp, Homo sapiens
cccgctcagagccagtttctcccgctcagagccagtttctcccgctcagagccagtttctcccgctcagagccagtttctcccgctcagagccagtttctcccgctcagagccagtttctacacctgcgagattgacgccctcaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325389 - DNA, 960 bp, Homo sapiens
  misc_feature (46)..(46): n is a, c, g, or t
gagccggtacctttcaagcggagatgctggagggagaggagagccnggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325390 - DNA, 2291 bp, Homo sapiens
  misc_feature (2263)..(2263): n is a, c, g, or t
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagttttagtagcaagcggagcacctacgtccacaacgccctcaccttgacctcggtaacggggctntaggagaagaaatatagaggacaagatg

SEQ ID NO: 325391 - DNA, 1014 bp, Homo sapiens
tcttgaagaagtaacaagcctgtcttgaggggggttggggtctgctagggctctgcccaatgtggccccagatggactcccagcccctggtatagcccagcctggacttggtcaggctgagtgtgcgatggaccctgttacagaaaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325392 - DNA, 784 bp, Homo sapiens
ggtactgctcttgggggaggtgggagcaggagattgagagggagagaaagtgggtgagatgctggagaaagagaggagaggagaagaggcagagagcggtccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325393 - DNA, 688 bp, Homo sapiens
gactctctcctctcctctgcttctccagcatctcagccactttctctccttctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325394 - DNA, 2091 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagaggcagagagcggtctcaggctggtgggaggggcgcccacctccccacgccctcccctcccctgctgcaggggctctggagagaaacaataaagagattcacacacaa

SEQ ID NO: 325395 - DNA, 1673 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagaggcagagagcggtctcaggctggtgggaggggcgcccacctccccacgccctcccctcccctgctgcaggggctctggagagaaacaataaagagattcacacacaa

SEQ ID NO: 325396 - DNA, 1461 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgaggtgagtgtctgctggcaggcgga

SEQ ID NO: 325397 - DNA, 1502 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccgaggcagagagcggtctcaggctggtgggaggggcgcccacctccccacgccctcccctcccctgctgcaggggctctggagagaaacaataaagagattcacacacaa

SEQ ID NO: 325398 - DNA, 341 bp, Homo sapiens
gggctccttacccttggtgggggctatggatgtgtctggggggactgtcttccacccagctgtgctggtctaggtccctggctagtggggcaagagagatcctgcggccctggggtggggatggctcagggctgaggctccattctctggctagcacatggttggactgggcttctcttcctccccaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctca

SEQ ID NO: 325399 - DNA, 2307 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325400 - DNA, 2717 bp, Homo sapiens
  misc_feature (2717)..(2717): n is a, c, g, or t
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaaaaaaaaaaaaaaaaaaaaaaaaaaaaaaaaaaaaaaaaaaaaaaaaaaaaaaaaaaaaaaaaaaaaaaaagggtgggggggcggcgcgcggggcgccgcggggaggttttgaaacccccgcgggggggcggcggcggcgccccaagagaggagaggagagagaaagagagggagaaaccagggggttacacagagaagacccgcgcgggcgcagaagaaagaggggcggagggatcccacacacaatataaaacaacggccgcgcggggagaaaccacgaggagtgtggcgaggaaaacacccagaagagggggcttctggaggggcgcacaagcggggggatcttaaaacagggggggcacaaagaggggcggcagaaaaaaaatttaccccccccggcggcgggggcn

SEQ ID NO: 325401 - DNA, 1698 bp, Homo sapiens
gcagagtaggtctggatggggagatagatccggctctcctctccctccagcagcttccggtaggtggcaatctccacatccagtgccatcttcacgttgagcaggtcctggtactcgcgcagatggcgggccatctcatccttgaggtgccggatttcctcctccaggcgcgcaatgttgtcctggtagccactggcctcactggcaaatcggtgctccaattcccgcatctgcctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325402 - DNA, 2206 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325403 - DNA, 1109 bp, Homo sapiens
ggacagacacacacacccctgataaatcacatacactaaacacgcacacaccgcgcatgcacacaccacgagtgcacacacacatcactatccaccgggcacaaagcttttacctgctgctaatcccgtctcggcgttttctcccacaccctcatatttcaaacctactcccggtgtcattggccttcccgtcttctctaggtatggttattcggcgtgtgcaacacgccgaggacccataaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacacaa

SEQ ID NO: 325404 - DNA, 2045 bp, Homo sapiens
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatgagaccatcgcggctaagaacatttctgaagctgaggagtggtacaagtcgaaggtgtcagacctgacccaggcagccaacaagaacaacgacgccctgcgccaggccaagcaggagatgatggaataccgacaccagatccagtcctacacctgcgagattgacgccctgaagggcactaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagaggagagccggatcaatctccccatccagacctactctgccctcaacttccgagaaaccagccctgagcaaaggggttctgaggtccataccaagaagacggtgatgatcaagaccatcgagacacgggatggggaggtcgtcagtgaggccacacagcagcagcatgaagtgctctaaagacagagaccctctgccaccagagaccgtcctcacccctgtcctcactgctccctgaagccagccttcttccatcccaggacaccacacccagcctcagtcctcccctcacagcctctgacccctcctcactggccatccctcgtggtccccaacagcgacatagcccatccctgcctggtcacagggcatgccccggccacctctgcggaccccagctgtgagccttggctgttggcagtgagtgagcctggctcttgtgctggatggagcccaggcgggagcggtggccctgtccctcccacctctgtgacctcaggcactagcctttggctctggagacagccccagagcagggtgttgggatactgcagggccaggactgagccccgcagacctccccagcccctagcccaggagtattggtccagggagctaggcatggggcccacccctggaatcccagcactttgggaggctga

SEQ ID NO: 325405 - DNA, 826 bp, Homo sapiens
  misc_feature (771)..(772): n is a, c, g, or t
  misc_feature (780)..(781): n is a, c, g, or t
  misc_feature (784)..(784): n is a, c, g, or t
  misc_feature (787)..(787): n is a, c, g, or t
  misc_feature (792)..(792): n is a, c, g, or t
  misc_feature (800)..(800): n is a, c, g, or t
  misc_feature (807)..(807): n is a, c, g, or t
  misc_feature (809)..(809): n is a, c, g, or t
  misc_feature (811)..(811): n is a, c, g, or t
aggggaggggaggcgggggctgatgtcaggagggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccgctcggctccccgctgagctcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggctcaaggccaagctgcagaggagatccagtgaaggaagaaccaaaaccattggnngcctcgannggncgngatcngtaccaancgcatgncngngggccatggatctca

SEQ ID NO: 325406 - DNA, 1558 bp, Homo sapiens
gcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaa

SEQ ID NO: 325407 - DNA, 187 bp, Homo sapiens
gcggccgcctactactactactgctcgaattcaagcttctaacgatgtacggggacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 325408 - DNA, 4627 bp, Homo sapiens
gcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaaccgagcgggtgaggatgtaaagtgtggcatggaaagtaggagtcttcagcacacgggtgttttcttctgctgaatctttttatgctggagtttgagactaccgagttcttcctgctaacaggactggccagttctacaaagttgttgcttttcatgggcgcacgtaactgcccggagtggaagcgctgtgagtgccgatcaccgaatgggccgagagaaaagaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagccggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttggggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 325409 - DNA, 3699 bp, Homo sapiens
gcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagccggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgtgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttggggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 325410 - DNA, 2137 bp, Homo sapiens
  misc_feature (1954)..(1954): n is a, c, g, or t
gcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaaaaaaaaaacaaataaaaaacaaaaaaaacaaaaaaaacaacaaaaaaagaaaacgacaaccacaaacaaacaacaaaaacccaacaaaaggagccaaaaaacaacaatcaaacacacagaagacaaaaaacaaagaacagcgggggggggcaactactaataacagacacacagcaaggaccgcgccgacaacaaatatacgcgacccaggaacacatttgtatgagcaagaggacgcagccccacaagaaagaagtaggatagtccaaaacaaagagacaacagacacaggcgcggcttgcggaacaaaaaaacgtacgaagcaggacgaagacaaacagaccaacggtcggcgcgcgctcatagtggaaggacaacaccacccactctccaggnggggggagcggaaagcatgaaacagagagaaaccccacatagcgaaaggcagatagacacggacgagtcgagaaaaaacagaaaccaaatgacgagatgatcgtacgaacaaccacacaccagacgaacgatcgggcgagagaaacgtggaggcgaagacgcagacagtaaacgaccaacagc

SEQ ID NO: 325411 - DNA, 4402 bp, Homo sapiens
gcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagccggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttggggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 325412 - DNA, 4107 bp, Homo sapiens
cggttgctctgcaagtgttcggggcctctggctgctgaaggattcggtctaccacggaggcctgtgctgttaggccgcatcccactcagaattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagccggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttggggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaa

SEQ ID NO: 325413 - DNA, 1335 bp, Homo sapiens
gcccccgcctccgccgcggcccccacctctgcctccttctactcgggcgccccggcggccgccacctctccccagcccaggagaggctgcggagccgcagccgcccagaccgcgcagcgcgggaggcaggttccgcacgaaataaatcagaatgagttatgcagaaaaacccgatgaaatcacgaaagatgagtggatggaaaagctcaataacttgcatgtccagagagcagacatgaaccgcctcatcatgaactacctggtcacagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatccta

SEQ ID NO: 325414 - DNA, 3740 bp, Homo sapiens
cttccttgtactatccctatgaggcataatgattacaagctccatctgcgtacgacttacagacctggaatcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaagctggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 325415 - DNA, 1901 bp, Homo sapiens
ggccccacagttctgaagcctgggccccgcagaggcctgcattcaggtcagttctcagcacgcgattaaaagatggaggttgtggtgttttctcagggcagcaacaggctctcttccctaagtccaggtcctcgaatccgcaggggctcagaatagacatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaagctggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 325416 - DNA, 4051 bp, Homo sapiens
cttccttgtactatccctatgaggcataatgattacaagctccatctgcgtacgacttacagacctggaatcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaagctggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaaaaaaaaacaaaaaacagacacgcccgaaaacaacaagaccgcagcacaacggataccaccacaccaagacgggcggggcccgccccacaagaagtcccccccggagggggggccccaaacggacaacggcgagcacgcccagtcgtggtgtggacaaaaacgcgggcgcccacacagaggggaccggcgcacacacagcggcagaaaggagccgcgcgcgcggcagcctgcaaacagaggctggtagacggcggcgcaacccggggccagcgggggtgaccgtaggaacgaggccccccaacttggggaga

SEQ ID NO: 325417 - DNA, 3853 bp, Homo sapiens
cttccttgtactatccctatgaggcataatgattacaagctccatctgcgtacgacttacagacctggaatcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaagctggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaactacacaaaacaacaacccgcaacaaacaacacaccacaaaacacaaccaacaaacgaacaacacaaacaaaaacaaaagaagggggaaaacacccgcagggacaaagaacaa

SEQ ID NO: 325418 - DNA, 3816 bp, Homo sapiens
cttccttgtactatccctatgaggcataatgattacaagctccatctgcgtacgacttacagacctggaatcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaagctggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaaaaaaaaaacaggggggcgctaaaaatccccggggcccatacctaccccctcttgacaagggccccaaaggggaaac

SEQ ID NO: 325419 - DNA, 3808 bp, Homo sapiens
cttccttgtactatccctatgaggcataatgattacaagctccatctgcgtacgacttacagacctggaatcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaagctggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaagaacggaatcacctcttaattctccctgtcaccaaaaacacccatccagctgaacagccaatgtccca

SEQ ID NO: 325420 - DNA, 1032 bp, Homo sapiens
  misc_feature (18)..(18): n is a, c, g, or t
cgagctcggtaccccttntggggtctttgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 325421 - DNA, 497 bp, Homo sapiens
gaattcctcatggaattctccaaggttctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 325422 - DNA, 1103 bp, Homo sapiens
cttccttgtactatccctatgaggcataatgattacaagctccatctgcgtacgacttacagacctggaatcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaa

SEQ ID NO: 325423 - DNA, 825 bp, Homo sapiens
agacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagg

SEQ ID NO: 325424 - DNA, 808 bp, Homo sapiens
gaattcctcatggaattctccaaggttctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaaaaaaaaacaaaaaacagacacgcccgaaaacaacaagaccgcagcacaacggataccaccacaccaagacgggcggggcccgccccacaagaagtcccccccggagggggggccccaaacggacaacggcgagcacgcccagtcgtggtgtggacaaaaacgcgggcgcccacacagaggggaccggcgcacacacagcggcagaaaggagccgcgcgcgcggcagcctgcaaacagaggctggtagacggcggcgcaacccggggccagcgggggtgaccgtaggaacgaggccccccaacttggggaga

SEQ ID NO: 325425 - DNA, 722 bp, Homo sapiens
  misc_feature (708)..(708): n is a, c, g, or t
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcgactttcatacggtagntaaccccacaggcg

SEQ ID NO: 325426 - DNA, 345 bp, Homo sapiens
atgtggctcaaactcttagttggaagagagtaagaattgaggtaatccgcccaggtacggtggctcacgcctgtaatcccagcactttgggaggccgaggcgggcagatcgcttgaggtcaggagttagagaccagcctgcccgacatggtgaagccccatctttactaaaaatacaaaaattagccgggtgaggtggtgctcacctttaatcccagcgactcgggaggctgaggcaggagaatctcttgaacctgggaagcggaggttgcagtcagctgagatccccccagtgcactccaacctgggtgacaatgaggctctgtctcaaaagagaaaaacaaag

SEQ ID NO: 325427 - DNA, 480 bp, Homo sapiens
gtataatgtcagtgctaagtagtattttttattaataaaaagtcttggtttcattggcaatgtcagacttttagggtagataacaagtattctgttggcacatttaagaatggcctttgtaggagggaagagttcagatagtttatatctggattttttttttttttttaagaaagagttttgctctgtcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatcctt

SEQ ID NO: 325428 - DNA, 4018 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325429 - DNA, 4054 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325430 - DNA, 5496 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatcttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgttacaactcactgaataagataccatgattccatgttgacttaaaaatggagagaagagaaagctctaacttgaatgtcagctaatttaaggtgaaaggattttatgtgttagaaaaatcaccattttgcaaactagttttcagaatcctt

SEQ ID NO: 325431 - DNA, 4200 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccaaaaaaaaaagggggcggtgaaaatttactaaggggcaagttacgcttacacagttttttaaagggtcttagggggattaagaagaaggagggttaaagtggaggaaagtgtggatttgaggcctttgggggatatggacactcaaaagcgggataatagttgaagttgcgggattggttaac

SEQ ID NO: 325432 - DNA, 2393 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgag

SEQ ID NO: 325433 - DNA, 4102 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagtgtttagaatctccagtggggaagaggaaaagaagcatgactgttagtacttctcaggacccatctttctcaggattaaaccagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325434 - DNA, 2313 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctggga

SEQ ID NO: 325435 - DNA, 3693 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgtt

SEQ ID NO: 325436 - DNA, 2466 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaacgcgatgcgcccgtatccctctttcccggtggttgacgtttagggtgcactat

SEQ ID NO: 325437 - DNA, 2364 bp, Homo sapiens
  misc_feature (2363)..(2363): n is a, c, g, or t
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggaaggagggggatcctcaagagtcagctatcaccatgactgcgctatcaggna

SEQ ID NO: 325438 - DNA, 3953 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325439 - DNA, 3964 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcacccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325440 - DNA, 3790 bp, Homo sapiens
aaccgtcttttaaggtggaaacggcaaaatcctctttcagtgattcccatgtttttttttttttaattcttaattctactgggcctcttgttccaattagaacagtttccgatcgcctagttccttaaaaacctctcactacgttcagaggttgcctcttttttctggatgaatcattttcctgcactttagaggacgtacggatttcgtcactaccccctgaagaggcctttgaggctggttgcctcgttttataattaccgagagctttctctttccagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325441 - DNA, 3765 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325442 - DNA, 2113 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcacatcttt

SEQ ID NO: 325443 - DNA, 3502 bp, Homo sapiens
gcctccaggttaaagaacctcataccaagaatttcaggcttaagaaatatccatgaatatctgaatgatctaggttaaactgtaatgtcactttttctgtacgccaaggcattacctatccttaaatatatatatatctaaatatatatttgtatgtatgtgtatatagatatgtatgcatgaatacattcatatagatgttcaattagttttaagttgtaactccttttcagtacttctgaagtttttttttaatgagtttctgcaaaacatagaaatgtcatcctgcttggttcattaagctcatttagagggttgtttagccaaatcgtttctgttcttttaaaattaaattgtaagacagttgtttgtcagattttggattccatggaaaaagttttgtttagaggtaggtaacacatgaactttttaaaatcaccttaaataagtagcttcttgcgtaagacaccaaatagtgttccctcctcatttgggaacatttcttctgggtacttgactttctttcatatgttttttcataataatagttccagtttataaaattacgttctcttttctagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325444 - DNA, 1585 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagccttcagataaaatgctgaaggctgctgcaggagagttcgcagataatccctgctcttctgtgaagcgaggcaacatggttcgggcagctcgagctttgctctctgctgttacccggttgctgattttggctgacatggcagatgtctacaaatta

SEQ ID NO: 325445 - DNA, 1307 bp, Homo sapiens
  misc_feature (1260)..(1260): n is a, c, g, or t
  misc_feature (1272)..(1272): n is a, c, g, or t
  misc_feature (1280)..(1280): n is a, c, g, or t
  misc_feature (1292)..(1292): n is a, c, g, or t
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttccngcagaatttgcnatgtactnaaactattgtcnggggtagaagtggta

SEQ ID NO: 325446 - DNA, 6436 bp, Homo sapiens
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagctttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtgaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325447 - DNA, 5653 bp, Homo sapiens
aaaaaaaaaaaaaaaaccccacaaccatgttataggaaaagttagtataaatgacatagcataattaatatattcaaaataacttttaaaaagttgtcttgtagcttgaagggatcctaaatatcaaaagcccatcacaaacttacaagccttactgctacgtaaatatccctttgaactagtttctggttctatttaaaaagtcgaaaacagttgaaattaatttacgaataagaacagatacacactttgtggggaggctgaggtggtaggatctcctgagcccaggagttttaagtccagcctgggcaacataacagcaagaccccatctcaaaaaaaaaaaagcatatcttttgtttatttttttaatagacaaagtctcactatgttgcccaggtttatttggaactcctggctttaagtgatcttcctgcctcagcctcccaaagtgttagcattatagatgtgagccacctcgtctgggccagagcatacattttagatttcagattgggtggcgggcagggatagaatatccttgttagttatataaaaataaacttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325448 - DNA, 6409 bp, Homo sapiens
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagctttttttttttactgtggacagtaaagctggaaagatctaaataacccaacaggaaatgcggatgaaagtgcaagagttggtttgtggtcatctggagtccatgtctccaagactgctggaccttcaaattctgcaactttgttagaagacctagaagaatacagcgttgctatgactcagtggtgttgaatgcagaccatctaccagctggggaaagaatcaattataaacaggtgaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325449 - DNA, 6382 bp, Homo sapiens
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagctttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtgaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325450 - DNA, 5496 bp, Homo sapiens
ttaaggaagtgtaagttatctagtggtgaaaacctttttaggaggtttaggtctccttttctccttgagatattaaaaataattttgtggagctgcttgctgcttaacactgttttagagaggccatggggaagaagcaaagtgttttactcaactaagattcaaatgctaaatgttgctcttgaacattttagattagtgttttgtttatgtagttgatttttagtgttttctgtattgtagtttgaaaaatgccagttgtatgagactggattctttggtcacctcccaaagtgttagcattatagatgtgagccacctcgtctgggccagagcatacattttagatttcagattgggtggcgggcagggatagaatatccttgttagttatataaaaataaacttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccattttagtttgttagtgatggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaacttttcctgtattttaaaattgaaatttggtcacagggtatagtcagatttttattaaggtttggtttgacaacctttaaaagaaaggtttacctcgctaatacttcttaataacatgcatcaaatgatattccctatggtgaagtatattctcaaagttatgttatctttcatttttggcatttggtgcttatggacttagtacccaggcaacaaagatctattatgcacctactctcttgtatgttcgctattatttcccaaaaaaaaaaaggggcatatatgcataagaaataaatattagaattattttgtttctcccacaaagcccatgggagatggcccaacaaatgtttaaaaagtaaaagaagctgggcacggtggctcccacctgtaacccccacactttgggaggccatggcgggtggatcacgaggtcaggagtttgagaccagcctggccaacacagtgaaactgtgtctctactataaatacaaaaattagccaggcatggtggcaggcacctatagtcccagctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325451 - DNA, 1230 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaagctgcaccaagggaccaaatatgtaaggttgtgtaaggagtgtcccgctcttgag

SEQ ID NO: 325452 - DNA, 3861 bp, Homo sapiens
ttcaacaagtggttaaaaaaattagccctcctcaaagataaggacacagaatataagtgaatcattcattctacacactggcatcactcatttggcagaggagatgtgtcctcaagagaagaggtattcccccaaggttacatcttaccaaagcagtttcaagaagtaaccatctatattagccggatgtggtggtgcacacctgtatccctactcaggaggctgaggcaggagaatcgcttgaacccaggaggcagaggttgcggtgagccaagatcatgccactgccctccagcctgggtgacagagcgagactgtctccaaaaaaaaagaaaaaagaactaaaagaaaaggagcagtttatgattgaagaaaacatgacctgggctgaagaagtgaggattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325453 - DNA, 3548 bp, Homo sapiens
aaaaatcaacgaatccaggagctgtttttttttcaaagattaacaaaacagactgcgagtcagactaataaagaagaaaagaaagaagattgattggagtgggctagaatgagctatagtttctagctcatttgtaaggaggtagacaaaggagcattggtgcctcagagtgggtgtctggtgagaggaaaaacggtgcttaagagattttcaggctattgctgtgggacaggcatattttctccctttgcctttagctgtagataaagtgtggttatgacctgaggcttcttgtattcaaacttggcctagggcctatgtagaggccctagggtctacttgtggtggaggagggaagtatttgtagaatgtgtaggcttgagaagtaaataaagccaaaaaagcatcacttgcttacatttttaaatgagtcacaaaacaatctttctaatgcggccggtaaagaagttttaaaggtctaaggtttctctacagaaattacatgcttctcaggtctttgtttagtaaaataatacagataattatgctttgaatgcatttattattaaagctaaccgttttaatttgtgtcagaaataatttgtgcctatggtaggattaaaattgtattctttagttaaagcaaagcaatctgtttttcattgatttgataaatatgtgaatgcctaatatgttctgcatatgtaaaaatgcagaaacatgctcatttgaattactaataattattttagtatgctgagaggctttgaattcactgtaccactccttcctagagtcattcaaaacagaaaaaattagttttaagtatagattcatgtttttctgttttaaaaagttgagctaatacttttcacaagagacgaaataacatgagccactataattattggctcagttccacccaatttccatattttgggtgtaatttaaaatttttgacttggaattttaactttttttttgttttgattttttaccaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325454 - DNA, 1335 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccaggtatgtgaaattttgattagaatataaactgagactagtactgttgactggaatttcattattcataaatcagagtattaaaatcctgtgcatcactatttaaccttagcataggcagaaaaaaaataataatgtgacttgtagatattttcctatgggaataagacaaaacctggaattatcttggtttcttactcatctgtagactagtagttttcaatctgctccttcagatgaagttttagtgtcatatgtagcaggttattgtaagattttgtttggagagtttagagtgtatgtatgcatataattgttgataaatgtttattgacattttggttaaattaagcaaaattgaatattatgtattatgtgtgggactcttagaaaagctatatttttgaggataaaaaggtcctgaagtaatataaggaagaattttttgaccaagtagatgctgcttggagtaatggattc

SEQ ID NO: 325455 - DNA, 1720 bp, Homo sapiens
  misc_feature (15)..(15): n is a, c, g, or t
gtaggggcgggggangggggagaatgtattcattacacggatgatttacacgcgtccggattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325456 - DNA, 1002 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgtaagaacccggtgcatataggcgatccgctgagggaagcacggaatggggaagtgggtagaggcaggtaatgagaccagctgaatccgggtcttggtgttttagttacctgggttccctatagctggtggtttcctgtaagtcagtcatctcaattactgagtaaatttcagtttgccaacttatttcattgtattacactgctccatttcgcttccgtcattctcactcttcccgaggctttcatttgcagttatgcgtgcaggtcatct

SEQ ID NO: 325457 - DNA, 1910 bp, Homo sapiens
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagctttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtgaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaattgtaatcatttattgactcagcaattcctcagataacaggtcaaaagatgtacagatacattctgaagttttcttgctattaaaggcacaagagtttccttgt

SEQ ID NO: 325458 - DNA, 811 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggtaatcatctggggtggggttcacgataacgctgcgcttttactcattccccccaccaccaccgtgcacccccaaagtgctcgggcctctcctcatcgcacgcactcgccagggagtccagggagctagttttcctggcttacgaacctcgtccgctgtctccctaaaagggtcaagaacccgatag

SEQ ID NO: 325459 - DNA, 1814 bp, Homo sapiens
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagctttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtacaaaacaattcagtctgttttttaatgcagtttaggaatagtgtatacctcctatacttaaaattgtcatttatctttcccaactttaaatactcttttagtttctatagggaaggaagagttattacaggtttttttttttaattattctttaactttagatactgccaatctgatttaaaattctccaagcttaattctgtgcaacaaacagaaccacacaagcagccaggcactgtggctcactcctataatcccagcatttttgaggctagatgggaagatcacttgatctcaggattttgagaaccatccggacaacatagggagacctcatcgctattttaaataatttta

SEQ ID NO: 325460 - DNA, 1872 bp, Homo sapiens
gggaggctgaggtgggagtatcacctgagccctggaggttgaggctgcaatgagagctgtgatcatgccactgcactccagcctgggcaacagatgagaccctgtgtcacaacaaggaatttttagaaggtgctttttatattactcttcacagagttaaattttcagaggatttagtattattgaactaagtttcataagtgtattttaagcaagtaaatctctaatgtaggaaaatccccaaaatggtagcatttactaatgttttatatggtaatttttgaaaaatatatctgatatttcttcagtaaaaatggtgttgttttaataacttaataagaatgtttaaagattctttaagtctggcttatctagctaatgtgggcctattaaataataggcagacttctgccttccttatattctttagatcttttcaaatactccattccaatatccatcaaaagacttctctttatgccacttattatctatactagtttttaatgttcaattactacaagattataattactgtttttattcatgttcccaagaaaaatacataagattcacacccaacacacttcgaaatttatttcactccctttgactatatgtgattatcaaaaaagtatttttcaagatattaaaaataagtaaaggaaaatgaaatatttttaggacattcaaaatctaatgaagttcagtgtttctttaattgagggcaggcagaggtgggggagaatttcagaaggtagtgaacccaaaggtggattcttggataattctactattctgtactctcatcatcttaacccatctgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagctttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtattttaaaactccagaacgtcagaaatgtgtagcagaatgaattctgttataaggaagacaaaacaattcagtctgttttttaatgcagtttaggaatagtgtatacctcctatacttaaaattgtcatttatctttcccaactttaaatactcttttagtttctatagggaaggaagagttattacaggtttttttttttaattattctttaactttagatactgccaatctgatttaaaattctccaagcttaattctgtgcaacaaacagaaccacacaagcagccaggcactgtggctcactcctataatcccagcatttttgaggctagatgggaagatcacttgatctcaggattttgagaaccatccggacaacatagggagacctcatcgctattttaaataatttta

SEQ ID NO: 325461 - DNA, 1063 bp, Homo sapiens
  misc_feature (1048)..(1048): n is a, c, g, or t
aaaaaaaaaaaaaaaaccccacaaccatgttataggaaaagttagtataaatgacatagcataattaatatattcaaaataacttttaaaaagttgtcttgtagcttgaagggatcctaaatatcaaaagcccatcacaaacttacaagccttactgctacgtaaatatccctttgaactagtttctggttctatttaaaaagtcgaaaacagttgaaattaatttacgaataagaacagatacacactttgtggggaggctgaggtggtaggatctcctgagcccaggagttttaagtccagcctgggcaacataacagcaagaccccatctcaaaaaaaaaaaagcatatcttttgtttatttttttaatagacaaagtctcactatgttgcccaggtttatttggaactcctggctttaagtgatcttcctgcctcagcctcccaaagtgttagcattatagatgtgagccacctcgtctgggccagagcatacattttagatttcagattgggtggcgggcagggatagaatatccttgttagttatataaaaataaacttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctgcaagataaaaaccaaagaccaatgcgtattggggaaaagaatgcttagtactgcaagactgttgaatacctgttgaatattcctattgaggttttttcctaaacatacttcagtaacatcttaggacaattcactggagaaatgttgatccctggctggaatgtcataccattgacccatttgaagagttaaagctggatttgactgctctattctaccaggaatattgttagggtagccttttaccagtttctaaacaatcccaatcaaaaaaacacccccccnccccccaaaatacag

SEQ ID NO: 325462 - DNA, 669 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactgatggggagcatagactgcgcctatcttctcccatctagtatgagtgatgaaacaccgtaacagggcaaaccttttaggacttgctcatttccctcatctatatataacgcg

SEQ ID NO: 325463 - DNA, 516 bp, Homo sapiens
atctagctaacatgaataaaaggtttcagaaactgatttatttgggactaatttggcatttttctatttgtagtgtaaataggtgattttagtttggagtggatagagagttgaatcatactcaaagtagaatgtaacttttccagaatagttataattcatattagatataagtggctgtcagtgccttctggaactctccaactttgtacagtaccaaataaaaagcaattaaaatatcacatagtcatggagtctgatcaagtggtagcagtcctaaactagggtagggttccttaggcacaacccagaactggtcttgaaaaaggggggggaatagattacatgtggctcaaactcttagttggaagagagtaagaattgaggtaatccgcccaggtacggtggctcacgcctgtaatcccagcactttgggaggccgaggcgggcagatcgcttgaggtcaggagttagagaccagcctgcccgacatggtgaagccccatctttactaaa

SEQ ID NO: 325464 - DNA, 740 bp, Homo sapiens
ggctactgcactccagcctgggcaacatagtgagaccccatctccttaaaaaaatatatagaaagaaagaaaatgcttttcaattttggccccagccatttttacttaaatctaatatccatatattcctattagactcaccctttccctatagctaaaattaaattcttagagaagaaacttacatcagaagttaacagtttgggaaaaattttttttagatgtattatactttgattttttaaattctgggttaaaatttctcttgaatctcacaggtatatgtttatatgtctagtgcgttaaactaccatggttcttctcagtagcactgagtatatcttttttattttattcttttccacaggctgcaacaaagaaacaaaaatatgaaaagattagtgaaaagaagatgtccacgcctgttgaagttttatgtaaggtaagtatgcatgatgaatattaaaaaaatataaatgaagccaggcacaatggctcacacctgtaatcccagcactttgggaggccaaggcagtaggtcacatgagcccaggagttcaagaccagcctgggcaacatagggaaaccccatttctaccttaatagataaatgatccggctgggcacagtggctcaagcctgcaatcccagcactttagaaggccgaggtgggcggatcacttgagcccagaagttccacaagaccagcctgggcaacatggtgaaataccttatctacc

SEQ ID NO: 325465 - DNA, 903 bp, Homo sapiens
  misc_feature (864)..(865): n is a, c, g, or t
  misc_feature (900)..(900): n is a, c, g, or t
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaaaactggaccttaatgtttaactggaccannatgattaagttagaaatttgaataatgttccatancaa

SEQ ID NO: 325466 - DNA, 5347 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttatggcttacaaatgaatatttggaggtttgctttcacaatgatttcccatcaacaaatatttttagtaggatttttcctgtttctgttagtccttgcagtactcataaatgttttaagctgagcatactgtaatagtcataagtttaatttcattataataaaaataatcaaacaaaaggactttagaacccaagacaatgagctagttttccctaaagtttgctgaactattaaggaatatgttcttatagcttttgactagaatgagtcatgggaattctaagaagggatggcctagacatttttagctcagttaaattcagcatttaatgcaggtgagttcctgggtcgttttccaactagtctggaacagtctggttctgactcaaactggtataaagcattattttaggttttctctttgccagtttttaagcagttataaccatgtaaatcaagatgtgaggacatctatatgaagtatagtaaagaagtggtgtcagcagatcaatatgtgtgtcctgggtgtgctgctctcttaagtgagactttgtgagactatactttaaatgcattattaccattgcttacattttgggggattttcttcctcctcaaaacttccatttctattgtaatattcttaatgacaatcttttttttttttagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgtt

SEQ ID NO: 325467 - DNA, 3965 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325468 - DNA, 4496 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctagcagtgtatgtttgaaacagccaaagatggcgatgaaccaagtgtaaattgatctaagcagcccatgcagtttgtgttgaatcaacaaacagtgtattgttgaagtgaaattattttctgaaatgacttgttagaccagttttgaggacatactcaaaagtagagtaataatggctcctgggatggagaaatatgagatgaacctggaacattctattatggtgccacaaaggaaatctaaaaaaaaaaaaaaaaaaaaagtggttggctaggagcagtggcacacgcctgtgattccagcactttgggaggccgaagtgggcaggagttcaagaccagcctggccaacatagtgaaaccctgtctctactaaaaatacaaaaattagccgggtgtggtggcgggcgcctgtaatcccagcttttcaagaggctgaggcagaagaatcgcttgaacccgggagatggaggttgcagtgagctgagatcgtgccactgcactccagcctgggcgttgcagtgagactccgtctcaacaacaacaaaaaggtggatacatgtcaaaagggcacaggagccacttgaaggattatacttgctaaatctgtgtcaattatcaaaataaactggtagcaacgtt

SEQ ID NO: 325469 - DNA, 4077 bp, Homo sapiens
gagtgtaaacaaaatatattgagcctgtaaattgcttgaaagaaaatttcaatattttacagtatttcataaagtgcagtgtatataatgcctactgaaatctaaaaggtattgaaataaatttctccaacatttggtaacaaaacaaacgttgttgtttcaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325470 - DNA, 3193 bp, Homo sapiens
tggtattatgctatgcattcaaatatatcaaaataaagtatcctaagtatgaatagataccatttaatgaataagacgcagtttaattgaacaaggttggaaacctaatgtttctgtatttctcttttaaagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325471 - DNA, 3088 bp, Homo sapiens
cctcagcagcacgacatgcggctacagttagatgagatgctccggtctgctgaggagaggcggaggaaataggccgaggagttagcagccagacaaagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggtttctaagcatgaattgaggaacagaagaagcagagcagatgatcggagcagcatttgtttctccccaaatctagaaattttagttcatatgtacactagccagtggttgtggacaaccatttacttggtgtaaagaacttaatttcagtataaactgactctgggcagcattggtgatgctgtatcctgagttgtagcctctgtaattgtgaatattaactgagatagtgaaacatggtgtccggttttctattgcattttttcaagtggaaaagttaactaaatggttgacacacaaaaattggtggagaaattgtgcatatgccaattttttgttaaaaccttttgttttgaactatactgctttgagatctcatttcagaagaacggcatgaacagtcttcagccacagttgtgatggttgttaaatgctcacaattgtgcattcttagggtttttccatccctggggtttgcaagttgttcacttaaaacattcttaaaatggttggcttcttgtctgcaagccagctgatatggtagcaaccaaagattccagtgtttgagcatatgaaagactctgcctgcttaattgtgctagaaataacagcatctaaagtgaagacttaagaaaaacttagtgactactagattatccttaggactctgcattaactctataatgttcttggtattaaaaaaaaagcatatttgtcacagaaatttagttaacatcttacaactgaacatgtatgtatgttgcttagataaatgtaatcactgtaaacatctatatgatctgggattttgtttttattttgaaatgggagcttttttgtttacaagttcattaaaaactaaaaactgtttctgtaaggaaatgagattttttttaaacaacaaaaaatgccttgctgactcactattaaataaaaatctccccaattttttgatagactacttcaagccatttgttacatggtattcctttgcaagtcaatttaggtttcgtgttataacttttcctctttttttaagaaaaatgaaaaaagtaattcttttgtctgaaggggaaaggcattctttcatttttttctttttttttttttttttttatgacttgcaggcacaatatctagtactgcaactgccagaacttggtattgtagctgctgcccgctgactagcagctggactgattttgaataaaaatgaaagcattaaagggtttccctacaaaacatttttctttaaaatacttttgaaatggctataagcagttgactttcacccttggagagcatcacactgtgtgaggttcagtgattgttgaccctccccagcccctcctgcttctttaagttatctgtgtgcgtgcgcttcctctcaatcttctttgcacgctcatttctttttctctgacccatgagaaaggaaaacttactgatgataatttttaaatagtgtaatttattcatttatagcatgtcaggataaattaaaagaacatttgtctggaaatgctgccgggagcctattgtgtaaatgtaggtattttgtaaaataaccttgaaattgtaaattgacacgtgtttggtcagattgtgtcaagtttaatttgttttgttttcttttttcttttttttatttgaaaactactttagcaataattaattccatgattatcacattctgccattaagggatattagtaccgtaatactgaagaaattttattaagtctgaacttctggggtaggcagcttctttgtttcttttctatccacccttgtcggttgaggtatttgtttcttgactaataaaccctttgatacttttagccagaaatcagtctcataaagctatttttgagtatagtttgtgtaaaataaaaatgtttagctttggtaataacttccaagctgaactccctctagcaagatatttttcagtgcttttatttactatgcacttagactatgcactttttctgaaatatttttgtaacacttttttgtatttttgccatttgaaaaggttgtggtgtagttggtctgtaattaagttgcagatttaaaactgctgttagctttgtaaatcaaaatataggtgttttttgtcctggtatatcgtcattccatctgcagctggagctggaatcccattgatcttctagctaccattcattttcttcactgttcacaaaagaagagtgtgaaattcagtgaatgctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctccca

SEQ ID NO: 325472 - DNA, 1493 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggtcagtttttaaggtattttaagattataaactctgtgagggaaattggttaaatttacctaacaaattcattctgataaatactaaagtaaagcagatctagctaacatgaataaaaggtttcagaaactgatt

SEQ ID NO: 325473 - DNA, 2034 bp, Homo sapiens
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttccagtgggcagggtcagcaggcccaaacccccacaggcaagcaaactgacaaaaccaagagtaacatgaaaggttagtagccaagaaccaagtgacgttacagggaaaaaattgaatacaaaattgggtaattcatttctaacagtgttagatcaaggaggtggttttaaaatacataaaaatttggctctgcgttaaaaaaaaaaagacgtccttggaaaatttgactactaactttaaacccaaatgtccttgttcatatatatgtatatgtatttgtatatacatatatgtgtgtatatttatatcatttctcttgggattttgggtcatttttttaacaactgcatcttttttactcattcattaaccccctttccaaaaatttggtgttgggaatataatataatcaatcaatccaaaatcctagacctaacacttgttgatttctaataatgaatttggttagccatattttgactttatttcagactaacaatgttaagattttttattttgcatgttaatgctttagcatttaaaatggaaaattgtgaacatgttgtaatttcaagaggtgagtttggcattacccccaaagtgtctatcttctcagttgcagagcatctcattttctctcttaaatgctcaaataaatgcaaagctcagcacatcttt

SEQ ID NO: 325474 - DNA, 1025 bp, Homo sapiens
  misc_feature (968)..(968): n is a, c, g, or t
  misc_feature (971)..(971): n is a, c, g, or t
  misc_feature (1013)..(1013): n is a, c, g, or t
  misc_feature (1024)..(1024): n is a, c, g, or t
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttangcnattttggtttggccaaaaagtactcagacacggacgagaccntgtgccgaatnt

SEQ ID NO: 325475 - DNA, 947 bp, Homo sapiens
  misc_feature (773)..(773): n is a, c, g, or t
  misc_feature (778)..(778): n is a, c, g, or t
  misc_feature (786)..(787): n is a, c, g, or t
  misc_feature (812)..(812): n is a, c, g, or t
  misc_feature (838)..(838): n is a, c, g, or t
  misc_feature (863)..(863): n is a, c, g, or t
tcggagcgagcgcccgagatccctttcccagagtgctctgcgccgtgaagaagcggctcccggggactgggggcattttgtgttggctggagctggagtaacaagatggcgtcgtccgcggagtgacaggggtccctctgggccggagccggcggcagtggtggcagcggtatcgccgccctagctcaccgcgccccttttccagcccgcgacgtcgccgcgcaagcgaggcagcggcggccgccgagaaacaagtggcccagcctggtaaccgccgagaagcccttcacaaactgcggcctggcaaaaagaaacctgactgagcggcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggatggcgagtagcagcggctccaaggctgaattcattgtcggagggaaatataaactggtacggaagatcgggtctggctccttcggggacatctatttggcgatcaacatcaccaacggcgaggaagtggcagtgaagctagaatctcagaaggccaggcatccccagttgctgtacgagagcaagctctataagattcttcaaggtggggttggcatcccccacatacgggtatggtcaggacttcaatgtctggtcaagaagggtcacantgaanactgtacnntatgtagctgaccagatgatcagtngaattgcatatgtgcatacaagaatntatcacagagcataaccagatactnctatgggatgggcgtcactgataagtatctgatgattggttgcaaagtcaggcacagcaggaccatcatcaggagtctatgact

SEQ ID NO: 325476 - DNA, 309 bp, Homo sapiens
tgcagcaccagccagaaaagcaaagctccagcctccactccccagctcagttcacccaagagcagcaggcggccagtcccaggggctgcactgctgcaaacctgctcaaaacctccagccgccacgtggcaacttgctccccagctctgagagtgcaggaccggggcgcagagacgacagaagaggctttaaatatgcagaatgactgtctaggtcaacgcacaaaaggaaagggccccaggtgtgggagatgcaaggggtgagagggaaagctcagaagagacgtgttggagctgctggcctgcagca

SEQ ID NO: 325477 - DNA, 4685 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325478 - DNA, 4765 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggataggtgggacccagggccgcccggggctgttgctggacactgagccctggaaatggggccaccgagccccgctgagccgttctgccttggggctagctgaccccacctctccttgttccagcctcttgaagccagggctcagggctgttgtgggaggggccgccgccgtgtccactcaagccatgcacaagtaggtttcctgccagcatcccctccccactcctcttcctatgaccatcatccctctaattcccttctgtctctcctcagcggctcgcctaagtccagtgcctcccaagcaggggctgcagcggggcagggagcccccgcccctgcccctgcctcccaagagccccttcccatagctggaccaggtgggacagggattttgggaggaggatggggcctgtgttggtgagggctggttgggagagagggacacagaggggatgcctgtctcacctgcccctgtcgctgtgtccctggttccggccccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325479 - DNA, 5377 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggataggtgggacccagggccgcccggggctgttgctggacactgagccctggaaatggggccaccgagccccgctgagccgttctgccttggggctagctgaccccacctctccttgttccagcctcttgaagccagggctcagggctgttgtgggaggggccgccgccgtgtccactcaagccatgcacaagtaggtttcctgccagcatcccctccccactcctcttcctatgaccatcatccctctaattcccttctgtctctcctcagcggctcgcctaagtccagtgcctcccaagcaggggctgcagcggggcagggagcccccgcccctgcccctgcctcccaagagccccttcccatagctggaccaggtgggacagggattttgggaggaggatggggcctgtgttggtgagggctggttgggagagagggacacagaggggatgcctgtctcacctgcccctgtcgctgtgtccctggttccggccccagcgacagcacctgctccacggccacttggctccattcagagaccaaacagcttcctcttccgttcctcctctcagagtggctcaggtgggtgtcctgccctccccagtgctgacccagtgcttgccagcaccaacggctacatcacccttctgccctgggagccctctgggtctgttgtaccttttgtacctttgcgttgaaaatcccacaagcaagccgggtgtggtggctcacacctgtaatcgcagcactttaggaggcccaggtgggaggatcgcttgagcccaggaattcaagaccagcctgggcaacatagcgagaccccatctccatgaaataaaaaaaaatcccacaagcagagaggcaggaggtgtaggtgccaggccactgggacccagctacagagtcagtggtgagcagtggaggcagccccatgcccccctttttctcctaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325480 - DNA, 4967 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtgggtgagttgggggcaaacctgtgggactggctggggtgctcagggagctgtgcggtggcctgaggctccagtgctctgtcctcctcaccctagggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcaggtacctcccttggtcccccgggggcgcaaggctgccccaactcctctgggaaccagtgcccaggggtgggagcccgcagcccgccaccctagtggtgtttcctcctagggttcccggtggtgtgctgtgaagatgtcttcctctcggaccctctgctgccccgggggcagcgtgttcccctgtacctgtccaaggccccccagcaggtgagagctctttcccctccctgtccttaccccagcctccaggcttgcctggcaggaaacacattccattctctctcctcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325481 - DNA, 4905 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtgggtgagttgggggcaaacctgtgggactggctggggtgctcagggagctgtgcggtggcctgaggctccagtgctctgtcctcctcaccctagggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcaggtacctcccttggtcccccgggggcgcaaggctgccccaactcctctgggaaccagtgcccaggggtgggagcccgcagcccgccaccctagtggtgtttcctcctagggttcccggtggtgtgctgtgaagatgtcttcctctcggaccctctgctgccccgggggcagcgtgttcccctgtacctgtccaaggccccccagcaggtgagagctctttcccctccctgtccttaccccagcctccaggcttgcctggcaggaaacacattccattctctctcctcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgaccccagacacccattgtccatagccttctcagggcagagtgggctggttgtgttgacaataaaacagtgttggtttgcaaaaaaaac

SEQ ID NO: 325482 - DNA, 4438 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325483 - DNA, 3239 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagc

SEQ ID NO: 325484 - DNA, 3172 bp, Homo sapiens
tggagggaaggaaatcttatctcctagctgggagtgctggccagctagagactgtccttccacgcctccacccgcaggatctgtccaaccatgcaccctccaccctggtgtctgtggatggtgggcttccatttgcagcggatgtctgctctcagatgaaggcacaggctgcccctgccctgcccagcatgccccctgccctgcatgccccctgccctgcatgtcacctgtcctacacatcccctgccctgcaggccccatcttgtcctgcatgtcacctgtcctgcacatgccctgccctgcactcctcctgcactgcactccccctgcccagcacgtcagcatgtgggcgtggttctggccccagcacgtgagggcaggggtgggagggactgtcctgctgctgctgctgacgtctgtcccttgtccttgtccacctgctctcctctcccccaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325485 - DNA, 2772 bp, Homo sapiens
ggacgcgtgggtcgacccacgcgtcggaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325486 - DNA, 3737 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325487 - DNA, 3870 bp, Homo sapiens
  misc_feature (1838)..(1838): n is a, c, g, or t
  misc_feature (1867)..(1867): n is a, c, g, or t
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccaggtgggacagggattttgggaggaggatggggcctgtgttggtgagggctggttgggagagagggacacagaggggatgcctgtctcacctgcccctgtcgctgtgtccctggttccggccccagcgacagcacctgctccacggccacttggctccattcagagaccaaacagcttcctcttccgttcctcctctcagagtggctcagccccttcctcagccagacctctgtctctgagaccctcgggcggtacnccgccacggttgccagagtgaggaaggancttaatgagcgtgaggtgcgtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325488 - DNA, 2016 bp, Homo sapiens
ccatctgtacgttctgtctcctggctactcgcgctgcttcttgtcctagccctggatatcatggggctggtgccgtccaaaccgttccgttatccaggctattttgaccacgctatgctccaggccacggtcaacttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325489 - DNA, 3023 bp, Homo sapiens
cggagctccacccccactgacgggttctgattggccgcttctgacgcgtctcggggccacgattggtccgtccggtcccggacaccgctccctcccccttgaggcaactacggcggctccaaggagggggtgggggaaggagggacggccggtcccgtcagtcaggcagcgggagccgccgggagcggatggcggcggccgtagcggctccactcgccgccgggggtgaggaggcggcagccacgacctccgtgcccgggtctccaggtctgccggggagacgcagtgcagagcgggccctagaggaggccgtggccaccgggaccctgaacctgtctaaccggcgcttgaagcacttcccccggggcgcggcccgtagctacgacctgtcagacatcacccaggctgacctgtcccggaaccggtttcccgaggtgcccgaggcggcgtgccagctggtgtccctggagggcctgagcctctaccacaattgcctgagatgcctgaacccagccttggggaatctcacagccctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctgccctgcagaggatctatttccgggacatcggtacgatggtgggctggactcaggcttccacagcgttgatagtggcagcaagaggtggtctggaaatgagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcatccccgttccccccaggtggcctgggaggtggccccctcgaggatgactccactagcgccctgggaccccaagtatgaagccaaagcaggacctcggccggtgtgggtgagttgggggcaaacctgtgggactggctggggtgctcagggagctgtgcggtggcctgaggctccagtgctctgtcctcctcaccctagggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325490 - DNA, 4809 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccaggtgggacagggattttgggaggaggatggggcctgtgttggtgagggctggttgggagagagggacacagaggggatgcctgtctcacctgcccctgtcgctgtgtccctggttccggccccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325491 - DNA, 4885 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtgggtgagttgggggcaaacctgtgggactggctggggtgctcagggagctgtgcggtggcctgaggctccagtgctctgtcctcctcaccctagggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcaggtacctcccttggtcccccgggggcgcaaggctgccccaactcctctgggaaccagtgcccaggggtgggagcccgcagcccgccaccctagtggtgtttcctcctagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325492 - DNA, 5085 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggtatgggggctgctttctaaagagtggtggcatgccggactcagccgagcatgtggcatggatggtgggcttccatttgcagcggatgtctgctctcagatgaaggcacaggctgcccctgccctgcccagcatgccccctgccctgcatgccccctgccctgcatgtcacctgtcctacacatcccctgccctgcaggccccatcttgtcctgcatgtcacctgtcctgcacatgccctgccctgcactcctcctgcactgcactccccctgcccagcacgtcagcatgtgggcgtggttctggccccagcacgtgagggcaggggtgggagggactgtcctgctgctgctgctgacgtctgtcccttgtccttgtccacctgctctcctctcccccaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325493 - DNA, 5777 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggataggtgggacccagggccgcccggggctgttgctggacactgagccctggaaatggggccaccgagccccgctgagccgttctgccttggggctagctgaccccacctctccttgttccagcctcttgaagccagggctcagggctgttgtgggaggggccgccgccgtgtccactcaagccatgcacaagtaggtttcctgccagcatcccctccccactcctcttcctatgaccatcatccctctaattcccttctgtctctcctcagcggctcgcctaagtccagtgcctcccaagcaggggctgcagcggggcagggagcccccgcccctgcccctgcctcccaagagccccttcccatagctggaccaggtgggacagggattttgggaggaggatggggcctgtgttggtgagggctggttgggagagagggacacagaggggatgcctgtctcacctgcccctgtcgctgtgtccctggttccggccccagcgacagcacctgctccacggccacttggctccattcagagaccaaacagcttcctcttccgttcctcctctcagagtggctcaggtgggtgtcctgccctccccagtgctgacccagtgcttgccagcaccaacggctacatcacccttctgccctgggagccctctgggtctgttgtaccttttgtacctttgcgttgaaaatcccacaagcaagccgggtgtggtggctcacacctgtaatcgcagcactttaggaggcccaggtgggaggatcgcttgagcccaggaattcaagaccagcctgggcaacatagcgagaccccatctccatgaaataaaaaaaaatcccacaagcagagaggcaggaggtgtaggtgccaggccactgggacccagctacagagtcagtggtgagcagtggaggcagccccatgcccccctttttctcctaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggtatgggggctgctttctaaagagtggtggcatgccggactcagccgagcatgtggcatggatggtgggcttccatttgcagcggatgtctgctctcagatgaaggcacaggctgcccctgccctgcccagcatgccccctgccctgcatgccccctgccctgcatgtcacctgtcctacacatcccctgccctgcaggccccatcttgtcctgcatgtcacctgtcctgcacatgccctgccctgcactcctcctgcactgcactccccctgcccagcacgtcagcatgtgggcgtggttctggccccagcacgtgagggcaggggtgggagggactgtcctgctgctgctgctgacgtctgtcccttgtccttgtccacctgctctcctctcccccaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325494 - DNA, 4470 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325495 - DNA, 3260 bp, Homo sapiens
tcgagtaccttggtcgaaggttatcgagggaagccagatttcacggttgtttgacagtaataagttgcaataatctccaggctctaggctcggaagaatgtggagagttttctagaagcctgtcgaaaaatgggggtgcctgaggtatgggggctgctttctaaagagtggtggcatgccggactcagccgagcatgtggcatggatggtgggcttccatttgcagcggatgtctgctctcagatgaaggcacaggctgcccctgccctgcccagcatgccccctgccctgcatgccccctgccctgcatgtcacctgtcctacacatcccctgccctgcaggccccatcttgtcctgcatgtcacctgtcctgcacatgccctgccctgcactcctcctgcactgcactccccctgcccagcacgtcagcatgtgggcgtggttctggccccagcacgtgagggcaggggtgggagggactgtcctgctgctgctgctgacgtctgtcccttgtccttgtccacctgctctcctctcccccaggctgacctgtgctcgccctcggatctcctccagggcactgcccgggggctgcggaccgcgctggaggccgtgaagcgggtggggggcaaggccctaccgcccctctggcccccctctggtctgggcggcttcgtcgtcttctacgtggtcctcatgctgctgctctatgtcacctacactcggctcctgggttcctaggccccaaaatcggccctccctcacccctttcccttcctctctatttataaggtccctgctccacccgaccccacctgcggtgccttcagccccaaccaaagacactagtgcacccccttcacagacactgacctcagaggccccactctggtgcccccagaccctgggcccccagcctctggcctccctccagtagccccacgagtccccacctctcagtgctgacggtgccttcatgtccccgccggccctgcccctgccctctgtaccccgtgaggggtggcaggagctggagtctcccccttcctcctgtgccctccccttccccccccaacagctgctatgggggggctaaattatctctattttgtagagaggatctatatttgtaggggttcggggcccaggccgggtccctatctctgtgtataaactgtacagaccgtggccgccctgcctgtgtgtgtgtgtgtgcgcgcgcgcgcgcgtctgctccgcgtgttggtggctgtggccatggctctgtgcccaccagcatctccctcctgagatgccggcctctcatgctcccggagcgtccgccaaccccccgtgtcacctcccttctgttatcgctgacagctttcttgcgtctcatttgtcgccgagccccgagcgcacggtgatgctcgggtctgcccccgaccccctgccacaggccggaagccgcagggggcaccgtggggaagctaacccggccccttcccccaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagccctctgggtggccctcaggtgtaactgtgtctgagagcacgtgcgtcgcggggttgttgggggggcctctgtttccggaattcaccgcccagtcgccagggggcgcccgcgggagcccggcgggggcacgcgccacgtggccgggagacgcacagggcgccagcgtcgccgcgaggcctctggggtgggttcgccaggagggcacgttcgcgccgcgccgcggagggaggctgagagggccgggccgggcggcggggacacggcggtaccgtcctgcgctcgggaacgcggaatgttgccctggtcgccgccgcggtggggcgcgggcccggaggaggcgcccgagggaccaggccttccggcgggcaaggaccagggcgagccctggagcgccggagcggacgcccccagggagctggggacacccccatgggacaggtgaggggctcggacggagccgtggggggacagagactgggggcctccatgcgttcaccacgcgctctacggaggcttctccattgtccctgctggagattgggtccctcggtctcccttgcaccaggcacccttgggctccaggggagggtgcgtgggggcggtgtggctgcagcctcagtccctgcccctccagcccacagcccccatcccgtagcccttcctggatctggagagagcagctgctgctgccccaccacctgccaggcccggccactgagcagccccccggagccccagatccccgttccccccaggtggcctgggaggtggccccctcgaggatgactccactagcgccctgggaccccaagtatgaagccaaagcaggacctcggccggtgtggggggccaactgtagctcaggagcctcgttctcaggccggacgctgtgtcacccctcattctggccgctgtatgaagcagcctcgggcaggggtctcaggcccgtggcccctgccacagggcactggaatggacagcaggcgcccccagatgcagggttcccggtggtgtgctgtgaagatgtcttcctctcggaccctctgctgccccgggggcagcgtgttcccctgtacctgtccaaggccccccagcagatgatgggctccctgaaactgctgccgccgccccccatcatgtctgccagggtgctcccccgcccatcaccctcccggggcccctccactgcctggctcagcgggccggagctgatcgctctcactggcctgctgcagatgagccagggggagcctaggcccagctcctccgcggttggccccccagaccatacctctgacccacccagcccctgtggtagccccagcagttctcagggtgctgacctctctctcccacagaccccagacacccattgtccatagccttctcagggcagagtgggctggttgtgttgacaataaaacagtgttggtttgcaaaaaaaac

SEQ ID NO: 325496 - DNA, 2291 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcaggcgggaggagccggcaggggaggagcggcggcgcccggacaccttgcagctgtggcaggagcgggaacggcggcagcagcagcagagcggggcgtggggggccccgaggaaggatagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtgccaaaactcagtgccctcaaggctcggaagaatgtggagagttttctagaagcctgtcgaaaaatgggggtgcctgaggagtcactgtgccagccccaccacatcctggaagaggagggggccccgggaaggggcctcccctacatcgctgctgtcgtccacgccctgctggaccggccttaggggtgaaggtgggggcacagggcccaccccgcccgggaccccgggagcagaagacgcgcctgggctccgcgctctcagagaagcacgtggtgagggtggcctgggcctgggcacccttggcctgccggcctggctgcctctggggtcgagggtctgggtggaaggaccgcgggtgtcgcaggtgtcgtgtcagccgcaataaacagaagccagaagc

SEQ ID NO: 325497 - DNA, 1986 bp, Homo sapiens
taaggctaggtatgaggccgggtggttaatcaggcagagggagatacctgaaccttagcctgggtgaatctcacagacctcacctacctcaacctcagccgaaaccagctgtcgctgctgccaccctacatctgccagctgcccctgagggtcctcatcgtcagcaacaacaagctgggagccctgccccctgacatcggcaccctgggaagcctgcgacagcttgacgtgagcagcaacgagctccaatccctgccctcggaactgtgtggcctctcttccctgcgggacctcaatgtccggaggaaccagctcagtacgctgcccgaagagctgggggacctccctctggtccgcctggatttctcctgtaaccgcgtctcccgaatcccagtctccttctgccgcctgaggcacctgcaggtcattctgctggacagcaaccctctgcagagtccacctgcccaggtctgcctgaaggggaaacttcacatcttcaagtatttgtccacagaggccgggcagcgtgggtcggccctgggggacctggccccttctcggcccccgagtttcagtccctggtaagtcctaggtggggaggaaggaagccctgggatactgaatgccccttcccggccccaggcaccccctgctttctggcaggaggatggggggctgttgtccagcatcaggctgaccagatccgcctggctggccccagccctgcagaggatctatttccgggacatcggtacgatggtgggctggactcaggcttccacagcgttgatagtggcagcaagaggtggtctggaaatgaggtaagggcgtcctgtccatgggtgattgagggtgtcagccctgggagagcacctctgaactggggacctccaaattgcagggtgccaggcagaagctggagctgtcctcttccttccctctgcccagcatccagggaagggctggctcagcagagacctgagcttagtccacacaggacccccaggtcctgagcccccatgtacagagaggccatctcccatctctgcctctgcctttacagtcaacagatgaattttcagagctgtcattccggatctcagagctggcccgggagccccgggggcccagagaacgcaaggaggatggctcagcggacggagaccctgtgcagattgacttcatcgacagccatgtccccggggaggatgaagagcgaggcactgtggaggagcagcgaccacccgaattaagccctggggcaggggacagggagagggcaccaagcagcagctgtggcaggagcgggaacggcggcagcagcagcagagcggggcgtggggggccccgaggaaggataggtgggacccagggccgcccggggctgttgctggacactgagccctggaaatggggccaccgagccccgctgagccgttctgccttggggctagctgaccccacctctccttgttccagcctcttgaagccagggctcagggctgttgtgggaggggccgccgccgtgtccactcaagccatgcacaacggctcgcctaagtccagtgcctcccaagcaggggctgcagcggggcagggagcccccgcccctgcccctgcctcccaagagccccttcccatagctggaccagcgacagcacctgctccacggccacttggctccattcagagaccaaacagcttcctcttccgttcctcctctcagagtggctcaggcccttcctcaccagactctgtcctgagacctcggcggtacccccaggttccagatgagaaggacttaatgactcagctgcgccaggtccttgagtcccggctgcagcggcccctgcctgaggacctggccgaggctctggccagtggggtcatcctgtgccagctggccaaccagctacggccgcgctccgtgcccttcatccatgtgccctcccctgctgtggtcagttggggctggggaagaggtgg

SEQ ID NO: 325498 - DNA, 728 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcagaaaaagaatttatgaaaataaaaaaaaatatatttttgg

SEQ ID NO: 325499 - DNA, 860 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattgatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaacaaggacggatagccacggc

SEQ ID NO: 325500 - DNA, 363 bp, Homo sapiens
  misc_feature (37)..(37): n is a, c, g, or t
  misc_feature (39)..(39): n is a, c, g, or t
  misc_feature (43)..(43): n is a, c, g, or t
  misc_feature (297)..(297): n is a, c, g, or t
tgactctacggatcccttatttgtccggcgccaggcnanatcnaagtagctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactantgagagcggcccgggaccaaaattagggggtaacccggaggccttccggaaatttccgtaaaatca

SEQ ID NO: 325501 - DNA, 1903 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaaaaaaaaaaaaaaaaaaaaaaaaaaaaaaaaaaaaaaaaaaaacaaaaaaaaaaaaaaaaaaaaaaaaaaaaaaacaaaacagaagaagagggggcggcgcagagagaaatcgaccaaccagcgaggaggaggacacgcgacgcaccacgacaccattgtatcagataaagagaagagaggggagcacacaccaactagagggagagtcttattataatagacaaaagagacaggcagagagagacgaagcacataaaaaaacaaacaagggcgaagcgagaagagaagagaacacacgagacaaaagaagagagcaaaacatacaaaggcaaaaaagagacacacacaagagaaggacgagggggagaaagaaagcaacgagcgggagcggaagagagaacacatcaaaccagagaagagagaataagacaagcgacgaaagagagagagaggacacacgacacaaacaatcaaggagaagacgggaggcgagaaaggtcagagaagagacgcacgaacaccacgacagacgtgaggcaagagatgttaaggccgaccgtagcggcgcacgagagagaagagaaagctacgggagacagacggcagagcgcagcagagcagacagtagcgataatcgagatgccagtgaaacgagaacgaagcgataagcaataagcaaccacaggaggcggggaccacgaagagtagacagataagaacgaagagaaggtggagcggaagagcacgaaacagcaagaccgagaaacgagcagaaaggagacagaagagcagaacgaagagaaacaaagagaaaggaagaatgagaaggcagagcgaagaaagaagaggaagaaaaacgaggacagacaaaagaggacaacgagaagaggagataagagaaggagaagaggcgaggagaaggagaagagacagggaaggaaaaagaagggagagagagagagaaagcaaggagacaagaggagaggcggagaagagcaagaagacaggcgaagacggcaaggaaaacggaagagaggaggaaacagaaacgacgagaggagaaacgagagagaccggaagaacgcccacacaacagaaagaaaacgagaggcgtgaaggacggacgacgagagacgaggaggagcggcaaaggaaagcaaaaacaacggagagagagcgagacaaagaagaaaacgagaaggaaa

SEQ ID NO: 325502 - DNA, 1296 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggtgagtgtccctccacccttcgccgggtccgctgaacagggaggctacccgctcccagctggggttggtgagagtgggactcgggggaagaagatggccctgggggtcccctgttctctgaattctggagctttgcttctccaggtagtacagactgagggatggtggggtctctgcaggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325503 - DNA, 1117 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325504 - DNA, 1324 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggtgagtgtccctccacccttcgccgggtccgctgaacagggaggctacccgctcccagctggggttggtgagagtgggactcgggggaagaagatggccctgggggtcccctgttctctgaattctggagctttgcttctccaggtagtacagactgagggatggtggggtctctgcaggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacggcgacggacagggtcagttgcggggactccagccattctgtgtcaacaacaacttgcaggaaaaaaaaggggggcaaaatcccgggggcagttcggaccttttgaagggcctaggggtatacagggggggtacagggacgcctggtattgggactgggggag

SEQ ID NO: 325505 - DNA, 1601 bp, Homo sapiens
gcggccgcctactactactaaattcgcggccgcgtcgaccttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaaaaaaaaaaaaaaaaaaaaaaaaaaaaaaaaaaaaaaaaaaaacaaaaaaaaaaaaaaaaaaaaaaaaaaaaaaacaaaacagaagaagagggggcggcgcagagagaaatcgaccaaccagcgaggaggaggacacgcgacgcaccacgacaccattgtatcagataaagagaagagaggggagcacacaccaactagagggagagtcttattataatagacaaaagagacaggcagagagagacgaagcacataaaaaaacaaacaagggcgaagcgagaagagaagagaacacacgagacaaaagaagagagcaaaacatacaaaggcaaaaaagagacacacacaagagaaggacgagggggagaaagaaagcaacgagcgggagcggaagagagaacacatcaaaccagagaagagagaataagacaagcgacgaaagagagagagaggacacacgacacaaacaatcaaggagaagacgggaggcgagaaaggtcagagaagagacgcacgaacaccacgacagacgtgaggcaagagatgttaaggccgaccgtagcggcgcacgagagagaagagaaagctacgggagacagacggcagagcgcagcagagcagacagtagcgataatcgagatgccagtgaaacgagaacgaagcgataagcaataagcaaccacaggaggcggggaccacgaagagtagacagataagaacgaagagaaggtggagcggaagagcacgaaacagcaagaccgagaaacgagcagaaaggagacagaagagcagaacgaagagaaacaaagagaaaggaagaatgagaaggcagagcgaagaaagaagaggaagaaaaacgaggacagacaaaagaggacaacgagaagaggagataagagaaggagaagaggcgaggagaaggagaagagacagggaaggaaaaagaagggagagagagagagaaagcaaggagacaagaggagaggcggagaagagcaagaagacaggcgaagacggcaaggaaaacggaagagaggaggaaacagaaacgacgagaggagaaacgagagagaccggaagaacgcccacacaacagaaagaaaacgagaggcgtgaaggacggacgacgagagacgaggaggagcggcaaaggaaagcaaaaacaacggagagagagcgagacaaagaagaaaacgagaaggaaa

SEQ ID NO: 325506 - DNA, 612 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325507 - DNA, 789 bp, Homo sapiens
tataaagcacatcttctctttagaaaatcaatgagaagccacaggtgatcgcggactatgagagcggacgggccatacccaataaccaggtgcttggcaaaatcgagcgggccattggtgagtgtccctccacccttcgccgggtccgctgaacagggaggctacccgctcccagctggggttggtgagagtgggactcgggggaagaagatggccctgggggtcccctgttctctgaattctggagctttgcttctccaggtagtacagactgagggatggtggggtctctgcaggcctcaggaaacccctaagagcaagtggagtccgagtcccttccccttgccagttcccgtcagcctgtgctgttggcgatggttctctgagcctgagcacagcgggtccgggccctgtcagcatggggccggaagccagttccacagaggaccccggctccggttcttccggagaggggtgttcatgctctgctgtctaaggtgatcagactcatcctcttcaaaattagatgtgggaaccaggagtgctcgtgtgctgagagcccagtgaggcacgggagcggcgtggccccccttccctgggaagatgttgaagaggggcagcgttggggggaggagggagctggtgctgcagtggccagtggctgtggctcatttcaggcctcaagctccggggaaaggacattggaaagcccatcgagaaggggcctagggcgaaatgaacacaaagcctcgaaatcagtgcgctccagctgatctcgttccgccggtt

SEQ ID NO: 325508 - DNA, 736 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325509 - DNA, 1022 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaggaattccggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattc

SEQ ID NO: 325510 - DNA, 478 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacgccgctcccgtgcctcactgggctctcagcacacgagcactcctggttcccacatcaatggcccgctcgattttgccaagcacctgggtcgtac

SEQ ID NO: 325511 - DNA, 359 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggcttcttgccagacaaacaacaatctattacaagacacgccaagctgaccggagacagagagctcacatacaggtacctgagtggcagtgatcacagtcgcagacagggctacgagaggactgcacgaaatataagcaaagtatcgctataac

SEQ ID NO: 325512 - DNA, 638 bp, Homo sapiens
  misc_feature (19)..(20): n is a, c, g, or t
  misc_feature (28)..(29): n is a, c, g, or t
cttaattcgcgaccgcgtnncggccttnnggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325513 - DNA, 632 bp, Homo sapiens
  misc_feature (37)..(37): n is a, c, g, or t
  misc_feature (39)..(39): n is a, c, g, or t
  misc_feature (43)..(43): n is a, c, g, or t
tgactctacggatcccttatttgtccggcgccaggcnanatcnaagtagctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325514 - DNA, 793 bp, Homo sapiens
aatctgcatggggctggggctcctgtgctatttgtacaaataaacctgaggcagaagcaggaagcagtgggaatagctttgcgaaaaatgggcgcaatggccaagccagattgtatcatcacttgtgatggtaaaaacctcaccataaaaactgagagcactttgaaaacaacacagttttcttgtaccctggcagaagcaggaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgcaaaaaaaaaaagtcgaccggtttttaatttagtagtagtaggcggccgc

SEQ ID NO: 325515 - DNA, 409 bp, Homo sapiens
ggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacggcgacaacaagttcacacaggtgatcgcgaagcaatgagagcga

SEQ ID NO: 325516 - DNA, 2301 bp, Homo sapiens
gttggagccggggctgagggtagaccccccagagatttgacatctgtgacacctgtgaaatgggttcgggtgctcatgactccatagctggcggaggagcacagcacagctgttgcaggggcagctaaggtttcctctgaaaatctgtcaggagcaaggactactttggcattaaccatcactgtttgatttcttgacaggtatgtgagatggggagtgatttgatttttttttttttaatagaaaagaggaatagttgttccccaaatgtttcttcctccactgccttccagtactttctttacatgaaagattagtgtaaaagtacaaaatcagcccaggaaacattcagcagccactagttactacatagaatttataaagtggatgttaaatggagagagagttggctcaggtcccctgaaatcttgtaggattaacttctctgaggaaaagaaaaatcaggtttgcattttgtattaatattctgcttttaggaagtaatagaaatacaagttgaagattgtctttacttacaaaattatattttaattttttttgagacatagtcttgctctgtcacccagtctggagtgcagtgctgtgatctcggctcactgtaaccaccatctcccagtctctagtgattctcatggctcagcctccctggttgctcagattacaagtgtatgccaccacacccagctaatttttgtattttttgtagagacagggtttcgccatgttggccaggctggtctcgaactcctggcctcaagtgatccgcctacctcggcttcccaaagtgctgggattataggcgtgagccaccgtgcccaaccacaaaattatatgtatatatatttaaacgtgtcaaacattttgctttctttctccattttaggtaaaatctcagccacagtaattgctttcttctgctttttctttataaaaacctgcttatgaaggccttctgatacagatagttaaatcgctgtagtaggaggctcaggttttctaagggattgcaaatgtgctgcatggtttttctattcctatgtcctggaagcctttgtttaaagtgggctttacaaatgtgtccctgaggtgcgtgagcaagagaacaatctcagccccaatacgggggctgtgttcttgccgtaagaatctgtagctgactggtgtgctgaacccgggcactctttttcctattgtttgccatggaaatttccactttggaccgagtaaggtcaactaggtgttttaaaattgtttttctcctatgtgattgggtgtgaagagggaaagtaggaatacactcagaattattactggattgcataaaagtgatagaagtgtagtggggttcacttcctcaattggtgcttcctagatttttctctcccatctcttcctgctttgtttctttaaagaaaaggctgttgtctctctttttaaatatttaagtctagtgagtttattttgtacgcaattgctttaattttaagggaagtaaatctgaaactatcttgaagcccaaaggatttttagtaagtggattaacagtgatgaggtatttgcgattactttaaatgccaaaatgcttgagaactttgccaggttaaaaattacttaatatattttagaatgtaggttagaaagtagtaggacaaggaatagctttattactcttgagaacacttggataaatgaaaatatagtttgcttccgtgttaagttgtggttgagctatggagtgaccctggagctgccgcatcccacaggcctgagctcagcaagggttcaattcaagagagatgacgtctccacttggataatggcagacagtgtgggtagcggccatgcactaggggaattcacctctgtcaaattaatactctcctgtctactggattcttcttgtgcttcacctggattaaaaagctgtactgcctcttttgaaacagataaaacctttctataagtctcaattaatgagcttgcacaatcttgtatatgtacaggaaacccctcctgtctcctaatgtgattagtactgtaaaatattctataaaactgattaaaaggggagagcagtttgattcacagggttttatgtttctgtcatctattttatattcagaagcatttctgaaaacgtatttgacttccgaatgttctgatgttctccgtgaattcacacacatcttttttatctgaacaataagggtgtttgctaagtatggcacaagaaggaactagaatgacctggcagtaactaacacaatggtgaacatctaa

SEQ ID NO: 325517 - DNA, 786 bp, Homo sapiens
gctggtctcgaactcctgacctcaggtgatctgccggcctcgacctcccaaagtgctgggattacaggtgtgagctaccacggctggcctgttttataatgttaaagcattcagatatgctagccttgtttgaagaccagttggggacaataggattagcttaccagctgttgagtattcataggagttactttttaggaagtggttgatttaataccaggctattccatactctcttgtccagttcacatgttaatcaatagcatactctgtgacattagtgatctagaaccacgttttcatctgtgcacagtgaactggcttatattgggatgaaaatcacaactttgacttaacacttaatctaactagcattaactagtccagacttacacatgtatttgcactgattttattcatgccctggtagctttgtttatctgggtcacaaaagctgaaattgtggtgtgctaagagaatcacaaatgtaacatacctcttatcttctatttagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtaagagggggaaatga

SEQ ID NO: 325518 - DNA, 428 bp, Homo sapiens
gcattagtattgggataagaagtaaaaccactctcttctcagcaactagtctcttgatacataattgttgctattgataattcagttaagtatttgaagtttgttttttctttcttttttttccagagaactcttattattagtcaatggtaatttattcttgagttgctctgaatacctactagtgccataatattccaaatgaacctgggtatccgtttcttgggggtgggttttgtttagaggttatgggtgatggtgaaagtgcacatgattctccccgtgacgaagcactgcagaacatctcggctgatgatctcccagaactttaggaggccaagacaggtggatcgctggagcccaggagttggagaccagcttgggcaacatagcaaaatcccatctctataaaaaagaaaaaggaaaaa

SEQ ID NO: 325519 - DNA, 276 bp, Homo sapiens
tgtaagtttattcaatgcaaaagaatcctctccaattttactgaggtggctgaccacgtccacgaccaaatccgtctcaactggaatttggctgctgacccagccccagcctcagctttcttgtcggcactaagtggcacagcactccatctgtaggggtaagtgtactggagagagttggttatacattctaggaatctcaaaggtaaagtatgatttaaaaatatttttttaaaataatttttttaagtttgcctacagctacaaatttttaag

SEQ ID NO: 325520 - DNA, 6998 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325521 - DNA, 6832 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttgtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325522 - DNA, 6917 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325523 - DNA, 6476 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgccaagatcgcactactgcactccagtctggcgacagagcaagactccatctcaaaaaaaaaaaaggcagttaacaactttaaaacttttaacaaatctagtattggacctgcttaataaattcagggtagagg

SEQ ID NO: 325524 - DNA, 4328 bp, Homo sapiens
  misc_feature (1168)..(1168): n is a, c, g, or t
aagccattcaacaaatctctaggaagttccatactttcccacattttcctgtcttcttctgagccctccaaactgttccatcctctgcctgttacccagttccaaagctgctttcacattttcgggtgtctttttagcagtaccccactctcggtaccaatttactgtatttgtctgttattatgctgctgataaagacatacctgagactgggcaatttaacaaaagaaagaggtttaattggacttaacagttccatgtggctggggaggcctcaaaattatggcggaaggtgaaaggcacatttcacatggcagcagacaagagaagagagcttgtgcagggaaattccgttttttaaaacaatcagatctcttgagacttagtatcacgagaacagcacaggaaagacatgcctccatgattcaattccctcccacaacacatggaaattcaagatgagatgtgggtggggaatacagccaaatcatatcaatttctaagcaacatatttggatatttactctggaaatgtagttacaaatgagcagttccaaatagaagagtgcaatttacttcagctttgcacaaaagcaggtaaagaggtatgcctatattttgaggctagaacaactagaatatcatatttcttttcttagtggtgataggaaagcctactttcctggaccagagaagcagatgtaagtagccttaggaattgctgtgctttttctgctgccagtcccctgctcatgattatggagaaaaatgtaactgagatgcttaggtagtgaggaggcttcaaggcttagggaatgggcactctagtaaatgtgacatttagactataagcaagtaattggtgggggatgtttgtgacctagtgacatataacctgtatttgttgttattgttggtcatctgtagctgtcaatttcctattaagtatgaggtcctatagctccagtataaaatacaccaagtatgcagaggggcttagtaacatttagtgaattaggtaactaagtcttcagccccatagatcctcccaaacaaaatgcaaaatgggtgtctgttctgcagctggcaccatgatcagtctctaccatgtctgcagcctgacatgctactttgtatatgtgctactgaagagagcacagacatgctnctttgtaaaaccagtctgtgcagtaatttttctaaagaaaagttaggacccttattcttcaaagagagtatgcactgaatatatctgatgtcatgcaaagtatttttccttttagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325525 - DNA, 5387 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgata

SEQ ID NO: 325526 - DNA, 5225 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgata

SEQ ID NO: 325527 - DNA, 5053 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325528 - DNA, 4477 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaaggtaactcaatacctttagtttaagcatctcttcacctgtaatactgttgggaagatttagaaatactgttttgttttgctagtttgttcaagtatctgcatgccttaaatacccaattattttatggaatcttaataaattaaactttgatgtcaaaccaataaattgcatttttctcctggattgaatatctgtagcttactttttaaattggggacattggtaaatttttggatctatacaaattttctcattttttttaaaaagccaaacatattttttttagaaacttttgagac

SEQ ID NO: 325529 - DNA, 384 bp, Homo sapiens
tacagtcacctcggccgtgattattaacaaagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325530 - DNA, 538 bp, Homo sapiens
gtttattttggaaggtagctgtataaaattgtttacttttttggtgaacagcctggcatcatttgagttggcaaaagcatctcttcctgaaagaagagagcatccaggagtaaagctagaaacttcttccaaaggcctcttctcagcacggtggcactcaggaactctggggagagctgctttcacgccatactcaagcgcttgatgaggaggagagaatgaagctaggagttttgaatgtgtttttgagcagaggttaagagtcagtggttttgattttagtcccaatggattcctgttaaattattcttcctatgacagatgactccgaagcaggttctgaaagttcctttaaaaaccttcattactattttaaggacaattatcagtcaacacttggaatttcttagcttttaaacttttcagcctcctttcacttagaaatgttggcacaccagttaacttccgagtagtgcagtatgttatatgtcacactactgactttatttaatttccagctcctataccatttagaaag

SEQ ID NO: 325531 - DNA, 346 bp, Homo sapiens
tgctgggattacaggtgtgagccaccgcgcccagccaggagattttgttagctagtgtttggcttttctccactatcactgcactttcctccaggatctttgttaaccctttgcttcccactggttatacaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcaggttagtatgctgtcattgtttgctttttcatttatacagaagttttaattaaatgcaaggtatcccaactctg

SEQ ID NO: 325532 - DNA, 1783 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttgggtctggctctgtcacccaggctggagtgcagtgacacgatctcactaatttttgtattttttgtagagacagggtttcgccatgttggccaggctggtctcgaactcctggcctcaagtgatccgcctacctcggcttcccaaagtgctgggattataggcgtgagccaccgtgcccaaccacaaaattatatgtatatatatttaaacgtgtcaaacattttgctttctttctccattttaggtaaaatctcagccacagtaattgctttcttctgctttttctttataaaaacctgcttatgaaggccttctgatacagatagttaaatcgctgtagtaggaggctcaggttttctaagggattgcaaatgtgctgcatggtttttctattcctatgtcctggaagcctttgtttaaagtgggctttacaaatgtgtccctgaggtgcgtgagcaagagaacaatctcagccccaatacgggggctgtgttcttgccgtaagaatctgtagctgactggtgtgctgaacccgggcactctttttcctattgtttgccatggaaatttccactttggaccgagtaaggtcaactaggtgttttaaaattgtttttctcctatgtgattgggtgtgaagagggaaagtaggaatacactcagaattattactggattgcataaaagtgatagaagtgtagtggggttcacttcctcaattggtgcttcctagatttttctctcccatctcttcctgctttgtttctttaaagaaaaggctgttgtctctctttttaaatatttaagtctagtgagtttattttgtacgcaattgctttaattttaagggaagtaaatctgaaactatcttgaagcccaaaggatttttagtaagtggattaacagtgatgaggtatttgcgattactttaaatgccaaaatgcttgagaactttgccaggttaaaaattacttaatatattttagaatgtaggttagaaagtagtaggacaaggaatagctttattactcttgagaacacttggataaatgaaaatatagtttgcttccgtgttaagttgtggttgagctatggagtgaccctggagctgccgcatcccacaggcctgagctcagcaagggttcaattcaagagagatgacgtctccacttggataatggcagacagtgtgggtagcggccatgcactaggggaattcacctctgtcaaattaatactctcctgtctactggattcttcttgtgcttcacctggattaaaaagctgtactgcctcttttgaaacagataaaacctttctataagtctcaattaatgagcttgcacaatcttgtatatgtacaggaaacccctcctgtctcctaatgtgattagtactgtaaaatattctataaaactgattaaaaggggagagcagtttgattcacagggttttatgtttctgtcatctattttatattcagaagcatttctgaaaacgtatttgacttccgaatgttctgatgttctccgtgaattcacacacatcttttttatctgaacaataagggtgtttgctaagtatggcacaagaaggaactagaatgacctggcagtaactaacacaatggtgaacatctaa

SEQ ID NO: 325533 - DNA, 7079 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325534 - DNA, 7387 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagcctggcatcatttgagttggcaaaagcatctcttcctgaaagaagagagcatccaggagtaaagctagaaacttcttccaaaggcctcttctcagcacggtggcactcaggaactctggggagagctgctttcacgccatactcaagcgcttgatgaggaggagagaatgaagctaggagttttgaatgtgtttttgagcagaggttaagagtcagtggttttgattttagtcccaatggattcctgttaaattattcttcctatgacagatgactccgaagcaggttctgaaagttcctttaaaaaccttcattactattttaaggacaattatcagtcaacacttggaatttcttagcttttaaacttttcagcctcctttcacttagaaatgttggcacaccagttaacttccgagtagtgcagtatgttatatgtcacactactgactttatttaatttccagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325535 - DNA, 5850 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgataaaaaaaaaaaaaaaaaaaaaaaaaaaaaaaaaaaaaaaaaaaaaaaaaaacaacaaaaaaaaaaaaaaaaaaaaaacaaagaaaacaaaaaaaagaacaaaagaaaaaaagaaagaacaaaaagaagagaaccaaagcaaaaaagagcggggggcgccgcgaagacccgccgagcagaaccccacacaagaatcaacaaacacacaccaacgtcaatacaaaagaaagacaccaaccccaaacgaagcgatggcagaaaacaaacacagcccatcgagcggcgcggcaaacaaaaacaaaacgcactgagcagaaggacaagaaccgagcagccgcccacgaagagaagacacacccatcgagggagcggacacaagcaaaggagaacacaacccgcagagaaggaaccacaaccagacgaggaagtaacaagagcgcaagaacacgactaacacacgaaata

SEQ ID NO: 325536 - DNA, 4999 bp, Homo sapiens
gctggtctcgaactcctgacctcaggtgatctgccggcctcgacctcccaaagtgctgggattacaggtgtgagctaccacggctggcctgttttataatgttaaagcattcagatatgctagccttgtttgaagaccagttggggacaataggattagcttaccagctgttgagtattcataggagttactttttaggaagtggttgatttaataccaggctattccatactctcttgtccagttcacatgttaatcaatagcatactctgtgacattagtgatctagaaccacgttttcatctgtgcacagtgaactggcttatattgggatgaaaatcacaactttgacttaacacttaatctaactagcattaactagtccagacttacacatgtatttgcactgattttattcatgccctggtagctttgtttatctgggtcacaaaagctgaaattgtggtgtgctaagagaatcacaaatgtaacatacctcttatcttctatttagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacggtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325537 - DNA, 4125 bp, Homo sapiens
tagaatatgaatattgttagttttcaaatgcgtggagagagattcataaaggaagaatggaaaaagacatttgttattatttaaaggggtttaagtctaaatttgaatagttttttttcctccttcagcatagagatgtctgaataaatgaagtctgcatgtaaaaatgcactgttggaagttctgttagcatgaattgctgataacagtgatttgagtgcaaacactttagaaatccgtcatccattcagtctgccctgaactttgacactgtcattctggtgatgatgagaaggtggagctactcttcccaatttcctgctttggcaaggctctcagacctagaaatgggatgagtaggcagctgcatggtgcctcttaacattgagatatgtgctctttttaagtcttacctcctaatctgcctttgggattatgctactggtgtcatactaacatcagaggtggtacaaacccaaggggctaattctctcactctcctttcccttgcagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325538 - DNA, 3077 bp, Homo sapiens
ctgatttaattatatggctacatattgtcctaaaataaactacactgaaacacttttggctttaagatcatggtgtctgcatagctagtgattaaaattatttctatgatttcctttttaaaattatttagatagtttttattaaactatttaaaaattattattttgctttggagactttcagaaactcaccgcagctgacgataaaactgctcaggtagaagattttctgcagtttctttatggtgcaatggcccaggatgtcatatggcaaaacgcgagtgaagaacagcttcaagatgcacagctggccattgagcgaagcgtgatgaaccggattttcaagctcgccttctaccctaatcaagatggggacatacttcgcgaccaggttcttcatgaacatatccagagattgtctaaagtagtgactgcaaatcacagagctcttcagataccagaggtttatcttcgagaagcaccatggccatctgcacaatcagaaatcaggacaataagtgcttataaaaccccccgggacaaagtgcagtgcatcctgagaatgtgctctacgattatgaacctcctgagcctggccaatgaggactctgtccctggagcggatgactttgttcctgtgttggtgtttgtgttgataaaggcaaatccaccctgtttgctgtctactgtgcagtatatcagtagcttttatgctagctgtctgtctggagaggagtcctattggtggatgcagttcacagcagcagtagaattcattaaaaccatcgatgaccgaaagtgaccaagaccaaggcccaccaaggcagcagactgttaatcagacaaacagatctctgagaaggtgcatcagctgctttgaaggctgaagattgttttgtatgatactgcacagcatcaggcattttaaagcagatctttactaaacaggttaatgagctaacaagcaggttctctcgtctttgggctctttcctttctgagttgcatattctattttcttgtccccaagtagagactagtactacaaaaagggaccacatttttcaagtatttctaagtataaaaaacaaaacaaaaatctcttaggaaatgtctagacctccattcttggattccctttctttccttttattttaaaaaagaacagtacccctcttttaagatgctgtcttacattaatgagcatctaatggaaagaaggtatgagttgcactgaggattagaatagtggtgcgttagtggcattatctataaatacactcacctaaattgaaagctaagaaggaaatgtaaatataatatatatttatatttgatgtaatatggacatctgcagattctaataaacaaggactattgctgatagtaggctgtgacatactgtcttgtgaaatggtttccttgacaaaatttaagctgagcttaaaagcaaaaaacaaaaagtacacagaaatatttattaaaatgtaatacagtttattgaactttctaggtatggagtttgatggacagggctgcctttaatgagtgtgaaggtcactaagtcacttagacatctcaccgtggaagtttgtgagcctgcattaggagatagactgattaccatacatgacataaaaaggaacagtggatagctcatactttatggtggttcttctcctccgaaataatatactgcagaaatcccagacagagctccttacaaacctttaattgtaatatatttttgatgattattcacattgaatgcacagaccaagaattcagtgaatgtcattttttaaaaaactaatttgtattgtctgctctagtgatacaagttttactagtgataaactattttaatcaaccatactattcttatggaaaaaaatatctattttggcaggtttctgtgcctttatttccctcttctgaaaaaaagtctgtgttttcatagtttggtttgcattgtatatcaataattaatcaggaatgggttttggtgcctgaaaaattggccatggaggcacaccaaagcttcaagcacaagtcttgtacatgggccatcactgtctggtttcacttcgtgtgtttcctaaacacatttagctgcttttttaacaaactcagccccatacttgagtcccttgttgttgggagcatttccaggcatcttttaagggaactgtgacaaacagcctcgggcagatgaacacggaggctctctgttgtctgtctctgagatctttgtgtctgggaatgcctaaagattttatttttttttctttgtttttattttattttattttatttttttgagacagagtctcaccctgttgcccaggctggagtgcaatggtgcgatcttggctcactgcaacctccacctcccagttcaagtgattcccctgcctcagcctcccgagtagctaggactacaggcgcatgtcaccaagcccggctaatttttgtatttttagtagaaacggggtttcaccatgttggccaggatgatcctcaatctcctgacctcgtgatccacccgccttggcctcccaaagtgcgggattacaagcgtgaaccaccctgcccagccagaaactagattttctttatgcctccaccccttcttattcatttactttacaataccaaaataacaaattgcataggagtgtgggatgtggtttctgccttctagagagagatcagaattaaactagtactatgaaatgtccttttgaatgttaggtcaagaaatccatgtacagagtcgtgcacttcattggctgtaactgtcaaacttgccttgtattagaagttaaatcccatcgtaaatacatcacgaggccagctgtgtgatttctgagacctagatgagagtccatttacttcagcctttgattcagtaaatgttaagcagcagaagacttcgaatggttgaaattcattgttacaggatttaactcataaaccaatgagagattttttttttctctgcaatggttgctaagtctattccatgttaacactgtggaaataaatatgaagatgtggacattgcaaaaaaaatct

SEQ ID NO: 325539 - DNA, 4469 bp, Homo sapiens
tgcaggacgcagggaagccaacaggcgagtggcgaaggtggcggcagcggcggcgggggcagtcaccggctagggcgacggctccgaggccgagtggcggtccgacagagtcctccgtgtcctcccccgcatgacccccttggggtaagtgtactggagagagttggttatacattctaggaatctcaaagggtctggctctgtcacccaggctggagtgcagtgacacgatctcagctcactgtaacctccgcctcccgggttcaagcgatcctcccatctgaccctcccaagtagctggcattcagtgatcagcctttgagcctttcccacattgaagatggtgaaactagatattcatactctggctcatcacctcaagcaggaacgcttatatgtaaactctgagaaacagctcattcagaggctcaatgcagatgtacttaagacagctgaaaagttgtatcgtacagcatggattgcgaagcaacagagaatcaatttggatcggcttatcataaccagtgctgaagcttcccctgctgaatgttgccaacatgccaaaattttggaagatacacaatttgttgatgggtataagcaattgggatttcaggagactgcttatggagaattcttgagtcgattgagggaaaatcctcgtcttattgcctcctctttggttgctggagagaaacttaatcaggagaacacacaaagtgttatttacacagtttttacctccctgtatggcaattgcatcatgcaagaagatgaaagctacctccttcaggttttgcgatacttgattgaatttgaacttaaagaaagtgacaaccctaggcgacttttgaggagaggaacttgtgccttcagcatcttatttaaacttttttctgaaggactgttttctgccaaacttttcctcacagccactttacatgagccaattatgcaactgcttgttgaagatgaagatcacctggaaacagatccaaacaagctaattgagaggttctctccatctcagcaggaaaaactctttggagagaagggctcagatagattcaggcaaaaagttcaagaaatggtggagtccaatgaagcaaagctagtggctttggtgaacaaatttattggttatctcaaacagaacacatattgttttccacatagtttaaggtggatcgtgtctcagatgtacaaaaccctctcctgtgtagataggctggaagttggggaggtcagggcaatgtgtactgatctcctgttggcctgcttcatttgtcctgcagttgtcaatccagaacaatatggaataatttccgatgctcctattaatgaagtagcacgatttaatctgatgcaggtaggccgccttttgcagcagttagcaatgactggctctgaagagggagatccccgaacaaagagcagccttggaaagtttgacaaaagctgtgttgccgctttccttgatgttgtgattgggggccgtgcagtggagacccctccattgtcttccgtcaatcttctggaaggattgagcagaactgtggtttatataacctacagtcagcttattactctggtgaattttatgaagagtgtgatgtctggagatcaactgagagaagatagaatggctcttgacaatttattggcaaacctacccccggccaagccaggaaaaagtagcagtttagaaatgactccctacaatacacctcagctatctccagcaaccactccagcaaataaaaagaatcgattacctatagcaactcggagcagaagccgcaccaatatgctaatggacctacatatggaccatgaaggatcatctcaagaaaccatccaggaggtgcaaccagaagaggtgttggtcatttccttaggtacaggtccccagcttactccagggatgatgtcagaaaatgaggtcctaaacatgcagctttcggatggaggacaaggagatgtccctgttgatgaaaacaaactccatggtaaacctgataaaaccttgcgcttttccctctgcagtgataatctggaaggaatatctgaaggtccttcaaatcgctccaattcagtgtcctccctagacctagaaggagagtctgtgtcagaacttggagcaggaccttctggcagtaatggagttgaagctctacagctgttagaacatgagcaagctacaacacaggataaccttgatgataagctaaggaagtttgaaattcgtgacatgatgggattaacagatgatagggacatatcagaaacagtgagtgagacctggagtacagacgtcttgggaagtgactttgaccctaatattgatgaagatcgcttgcaagaaattgcaggtgctgcagcagagaacatgttaggcagtttgctgtgcctcccaggttcagggtcagtgcttcttgacccctgcactggttctaccatatcagagacaacaagtgaagcttggagtgtagaggtattgccaagtgactcagaggccccagacctaaagcaggaggagcgtctgcaagaactggagagctgttctggactgggtagcacatctgatgatacggatgtcagggaggtcagttcccgccccagcacaccaggcctcagtgttgtgtccggcataagtgcaacctctgaggatattcccaataagattgaagacctgagatctgagtgcagctctgattttgggggtaaagattctgtcactagtccagacatggatgaaataactcacgattttctttatatacttcagccaaaacaacattttcaacacattgaagcagaagcagacatgagaatccagctgtcttctagtgcccaccagctgacctctcctccttctcagtcagagtctctgctggccatgtttgatccactgtcttcacatgaaggggcttctgctgtggtaaggccaaaggttcactatgctaggccatcgcatccaccaccagatcccccaatcctggaaggagctgtgggaggaaatgaggccaggttgccaaactttggttcccatgttttaactccagctgaaatggaggcattcaagcaaaggcattcttaccctgagagactagttcgaagcaggagctctgatatagtatcttctgtccggagacccatgagtgaccccagctggaaccggcgtccaggaaatgaagagcgagaactccctccagctgcagccattggtgctacttctttggtggctgcacctcattcatcatcttcatccccgagtaaggactcctcaagaggagagactgaagaacgcaaagatagcgatgatgagaaatcagacaggaacagaccttggtggagaaaacgttttgtttcagccatgcctaaagctcctataccatttagaaagaaagaaaaacaagaaaaagacaaagatgatctggggcctgacagattctcaacactcacagatgatcccagccctagactcagtgcacaagctcaggtggctgaggatattctggacaaatacaggaatgccattaaacggaccagccccagtgatggagcaatggcaaactatgaaagtacagaggttatgggtgatggtgaaagtgcacatgattctccccgtgacgaagcactgcagaacatctcggctgatgatctcccagactctgcaagccaagcagcccacccgcaggattcagctttctcttacagagatgcaaaaaagaaactgaggcttgctctttgctctgcggactctgttgccttcccagtgctgacccattcaacaaggaatggtttaccagaccacacagacccagaagacaatgaaattgtatgcttcttaaaagttcaaatagctgaagcaattaatttacaagataagaatctaatggctcaacttcaagaaacaatgcgctgtgtgtgccgttttgataataggacttgtaggaaactgctggcttcgattgctgaggactacagaaaaagagccccatatattgcttatctcactcgttgtcgacaaggactacagaccacacaggctcacctggaaaggctattgcaaagagttttgcgggacaaagaagtggccaatcgatactttaccactgtctgtgtgagattactgcttgagagcaaagaaaagaagatcagggaattcattcaagactttcagaaactcaccgcagctgacgataaaactgctcagagtttctttatggtgcaatggcccaggatgtcatatggcaaaacgcgagtgaagaacagcttcaagatatgagagtccatttacttcagcctttgattcagtaaatgttaagcagcagaagacttcgaatggttgaaattcattgttacaggatttaactcataaactttctctgcaatggttgctaagtctattccatgttaacactgtggaaataaatatgaagatgtggacattgcaaaaaaaatct

SEQ ID NO: 325540 - DNA, 482 bp, Homo sapiens
gccaaatttttacaattcataagagcaaataatataaaggtttatctgtctaatatctatgttttatataataactaaaccaatgttgcatcccagatgtctctcaaagttttctttctccacttcttccattggaaaaatttataatttgagtaaatttcatttctatgtctatttggaggtaataataataataaaacagccctttgtgaattaatataaatggaaataacagaaactccagtttggaataacatgatttatgtgtgcaattctttaatatcctgtcaatttgaatagtgatgtttttatattcacagtcagttgaagatgccaataacagcggcatgaatctattggaccagtctgtcattaaaaaaggtatggataattccccccaaaaagtaagcaaagttctctcatgcattaacgtctttatgatgaattttcactttgggggaattcattatttgacaagacat

SEQ ID NO: 325541 - DNA, 543 bp, Homo sapiens
ctgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagctcagctcctgtgtccagctcgcttctctgctggactccttgattttttttttaatcattgtttgattttgagcagtaaccaggcttttttttccagatgttagtccacacctattcatccatggtgagtttggattcacgtgttaccagaattgcatgctccctcctctcactgtctctctgtctctgcgtctctgtgtgtgtgtgtgtctcacactctctgtctctctctgtcttcctttgagcgcctttggcttggtaatttagcaccataattggacgaggctgcagctgcttctctctgcattgtgtgttctccgtctgagctccatgagtcagctgggaggggagaggccgaaaagaaaaactttt

SEQ ID NO: 325542 - DNA, 2019 bp, Homo sapiens
ctgcatctggagccccgaagaacggcagaagaaaagaggccaaaaagacagcaaagagacagatgaatagttctgtctgtgtgtgacaggcatcgccaatcttgttggggtggggggcgggtgtaattttttttttttttttttgatggcttgtcctggaaacacatcaagctcagctcctgtgtccagctcgcttctctgctggactccttgattttttttttaatcattgtttgattttgagcagtaaccaggcttttttttccagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaac

SEQ ID NO: 325543 - DNA, 2085 bp, Homo sapiens
attaaggcatttagaatctccctccatacacactgttcctgtacccctgccttttgcctgctttgcactccccaaaaagcggctaaaatgttatagttaagtgggtgattcctttcccattttctccccaagcctggggtttgaaattgctgaaatcatgtggccctctgagtcaacttgggggtctaagtttcagatccttgcttcccttgtcccgggaagagcgtacaaaagccgggcttctccatttgtcacttgtattttttttcttcctctctgtactctctgtctctctctgcctctatctctctttctctgtctccttctctggctctcttccccttcctctctccgctcccaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaac

SEQ ID NO: 325544 - DNA, 1170 bp, Homo sapiens
ttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtggccggagcaattctattccgcagcgcttgggaggatccgcggccgc

SEQ ID NO: 325545 - DNA, 506 bp, Homo sapiens
acttggtgtctgtcctgtggcctcacacagagacacattctatcagccggtcatcaggatcgaaacttggtcacctttatggcaattttttctctctttctagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtggccggagcaattctattccgcagcgcttgggaggatccgcggccgc

SEQ ID NO: 325546 - DNA, 1971 bp, Homo sapiens
ttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaac

SEQ ID NO: 325547 - DNA, 1998 bp, Homo sapiens
ttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaac

SEQ ID NO: 325548 - DNA, 1307 bp, Homo sapiens
acttggtgtctgtcctgtggcctcacacagagacacattctatcagccggtcatcaggatcgaaacttggtcacctttatggcaattttttctctctttctagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaac

SEQ ID NO: 325549 - DNA, 4001 bp, Homo sapiens
tgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgccaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaactaaaaaaaaaaaaaaaactcgagttttttttttttttttttcaacgtacaaaagttttaatgagacaaatgtcaaacaagcacattaacttcttaaaaaacaaagataatctgaaagtttaatgacaaaaaacactttattcagaaaacttggcgtttcaacaattccaaacacatgttcacaaattttttctaaaaacagtcagaaattaaataccttggctccctttccctaaccggtttttggttttaattaaaaaaaaaaaactgtgttcactgaatgcaccactttttcttgcct

SEQ ID NO: 325550 - DNA, 3950 bp, Homo sapiens
tgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgccaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaactaaaaaaaacaaaaaaagacataactaaagaaagttgcaaaaccactgagctaaagtggtctatgagttgctataaaggaagctctcagtgaccaaaagaaaaaaacttctgggggggcccgggacccaattcggccttataggaggcggtttaacatttaatggcccggtgttttcaacgcgtttgaatgggaaaaccctggggttacccaaatttaatcctttgggactttccaaactgtggcctac

SEQ ID NO: 325551 - DNA, 2247 bp, Homo sapiens
acagaggcttcaatccctgacgctgcaccttgctggaaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 325552 - DNA, 1034 bp, Homo sapiens
tgagaactcactatgttgctgtggaggaaaagttaaatattaaatttgaattcaattgaacatggacacaaacaatggtcaccaagtcccagaataggttgtgtgagccccttgaggcattcatccagcactgtttcggagaaatctctacttcaatctattccgatacattagttattgaaaaacaatagacaatcacaaaaacaggttgacctttttgtgttccttgagcccagtcatgaagaaccctcgtgacggggcctcatgccaacaacttgttacaaaaagagttagggtcccagactgcctcgtgccgaattcggcacgtggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaactaaaaaaaaaaaaaaaactcgagttttttttttttttttttcaacgtacaaaagttttaatgagacaaatgtcaaacaagcacattaacttcttaaaaaacaaagataatctgaaagtttaatgacaaaaaacactttattcagaaaacttggcgtttcaacaattccaaacacatgttcacaaattttttctaaaaacagtcagaaattaaataccttggctccctttccctaaccggtttttggttttaattaaaaaaaaaaaactgtgttcactgaatgcaccactttttcttgcct

SEQ ID NO: 325553 - DNA, 2671 bp, Homo sapiens
  misc_feature (86)..(86): n is a, c, g, or t
caaaggcattagggagtggctgtgaccccagagaacccctggcccaccttctgcacttgctaatgaagctttggcaggttacctgntttcaatatgttgtcagtgactgagctgggagtggagtccagagttctgggctaaggggtcttaggaaaatgtctgtgggcagccccaggacatccttcctgagttgcagttcagctgccatcacagtacttcagccccctccagcatctaggggctggctctgcttcttatcttgatttctctccctctgcagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 325554 - DNA, 3649 bp, Homo sapiens
tgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgccaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 325555 - DNA, 2468 bp, Homo sapiens
caaaggcattagggagtggctgtgaccccagagaacccctggcccaccttctgcacttgctaatgaagctttggcagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 325556 - DNA, 3646 bp, Homo sapiens
tgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgccaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgtcggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctggttcaggctgggagaggcagcccaggaagtctcatctggggagcatcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 325557 - DNA, 2344 bp, Homo sapiens
tgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgccaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtggaccgctcagccgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgctgagtgcatttggagggagtgagtggccctttcggatccagggaggctggtcctatggcctcatgttaaataggcggggcttgccttctggtgtcggacaagcttctgagacgtcatgaggagattctgcctttgccagtcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaacta

SEQ ID NO: 325558 - DNA, 827 bp, Homo sapiens
ttgcttcaaatgttttccaaactctgcgctttatttccagctcatatctcctgcaaagacatttctggcatgtcctatgcctgcattttcttgaataaacatggaaatacagaactgctgtactttccaacagatttccaaacagtaaaaaggaagctgacttgtatggagagttctggaccaatctgtttgggctacaattaccttggaaattttatacctatgttggtatgggtgagaggccaagaatcagatgcagatgatgactctgtattctaagaagtgatgtactttttcctaaaggttttgatttttttattggaacaaagctgtcaactcattagaaaatatactaaagaattcttttcatagctgtgtatgaacatgaggaagactggccaatataaactcctcatactgtagaatctgagtgaccacaaattctttgcagcaacttccatctcgtgaaatctacttcccactccttgcatctgggttggtcatgtgactgactttggctgattagcaaaccaagacttgaaatgtacttgcctactggagtttgccctctgtagctgctagaactcttttgccatcatatgaacaagtctgggttggcctcctggaagatgaaatactacctggatacaggccaaagctagcccagacatctcagctgacccagcagagtccccagacacgtgagtgaggccatccttgaccatcaagcccaaaaaggactgtcctagactggaagaaccacccagccaagtcacagattcctgagaaataataaacatgttttaggctaacttctgggtaggttt

SEQ ID NO: 325559 - DNA, 4823 bp, Homo sapiens
  misc_feature (127)..(127): n is a, c, g, or t
cgaaaacccggagcagctgcgtacgctcatggacagtcctccgaggggcgaagccgggcagctgggcatgctcagtagctgggggaggtttgggtggagagtagaaagctgtggctctgcctctcancccctcccgctggcccccgccccccttgcccctacccagccagtagtagttccccagcgtgcgcccggggagaccgggaacatggcgctgggagcgctgtagcagctgagaaggggctgaggcaccgccgcttcgctgacagccggccaccaggtttctgtctcccagtataatcatatccagccccatggctcttactggggcctctgaaatgtttatcaccaaatctgtgtctgcagttccaacctcttccctgagcatcaaagctgtatttccaactttcgctggatgcttctatctggaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 325560 - DNA, 4768 bp, Homo sapiens
  misc_feature (127)..(127): n is a, c, g, or t
cgaaaacccggagcagctgcgtacgctcatggacagtcctccgaggggcgaagccgggcagctgggcatgctcagtagctgggggaggtttgggtggagagtagaaagctgtggctctgcctctcancccctcccgctggcccccgccccccttgcccctacccagccagtagtagttccccagcgtgcgcccggggagaccgggaacatggcgctgggagcgctgtagcagctgagaaggggctgaggcaccgccgcttcgctgacagccggccaccaggtttctgtctcccagtataatcatatccagccccatggctcttactggggcctctgaaatgtttatcaccaaatctgtgtctgcagttccaacctcttccctgagcatcaaagctgtatttccaactttcgctggatgcttctatctggaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 325561 - DNA, 4780 bp, Homo sapiens
  misc_feature (127)..(127): n is a, c, g, or t
cgaaaacccggagcagctgcgtacgctcatggacagtcctccgaggggcgaagccgggcagctgggcatgctcagtagctgggggaggtttgggtggagagtagaaagctgtggctctgcctctcancccctcccgctggcccccgccccccttgcccctacccagccagtagtagttccccagcgtgcgcccggggagaccgggaacatggcgctgggagcgctgtagcagctgagaaggggctgaggcaccgccgcttcgctgacagccggccaccagatgttcatgcattctagagaaagtggaaaacttagaagcctaattaatgactgtcttctggacctctgagaccatgtttctagtgttttccgtggaatattatcagaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 325562 - DNA, 4674 bp, Homo sapiens
  misc_feature (127)..(127): n is a, c, g, or t
cgaaaacccggagcagctgcgtacgctcatggacagtcctccgaggggcgaagccgggcagctgggcatgctcagtagctgggggaggtttgggtggagagtagaaagctgtggctctgcctctcancccctcccgctggcccccgccccccttgcccctacccagccagtagtagttccccagcgtgcgcccggggagaccgggaacatggcgctgggagcgctgtagcagctgagaaggggctgaggcaccgccgcttcgctgacagccggccaccagaaatacactgtggtgaaatgcttccacctcttgctaaaatgaacactgagaaaaaatgaagaagactgacaagcaccagcgaaaagttgcagaatagaaatagccacactcctctggagtctttaattcatccacagccatcatataaaggttttggcatcatgtttgggaagaaaaagaaaaagattgaaatatctggcccgtccaactttgaacacagggttcatactgggtttgatccacaagagcagaagtttaccggccttccccagcagtggcacagcctgttagcagatacggccaacaggccaaagcctatggtggacccttcatgcatcacacccatccagctggctcctatgaagacaatcgttagaggaaacaaaccctgcaaggaaacctccatcaacggcctgctagaggattttgacaacatctcggtgactcgctccaactccctaaggaaagaaagcccacccaccccagatcagggagcctccagccacggtccaggccacgcggaagaaaatggcttcatcaccttctcccagtattccagcgaatccgatactactgctgactacacgaccgaaaagtacagggagaagagtctctatggagatgatctggatccgtattatagaggcagccacgcagccaagcaaaatgggcacgtaatgaaaatgaagcacggggaggcctactattctgaggtgaagcctttgaaatccgattttgccagattttctgccgattatcactcacatttggactcactgagcaaaccaagtgaatacagtgacctcaagtgggagtatcagagagcctcgagtagctcccctctggattattcattccaattcacaccttctagaactgcagggaccagcgggtgctccaaggagagcctggcgtacagtgaaagtgaatggggacccagcctggatgactatgacaggaggccaaagtcttcgtacctgaatcagacaagccctcagcccaccatgcggcagaggtccaggtcaggctcgggactccaggaaccgatgatgccatttggagcaagtgcatttaaaacccatccccaaggacactcctacaactcctacacctaccctcgcttgtccgagcccacaatgtgcattccaaaggtggattacgatcgagcacagatggtcctcagccctccactgtcagggtctgacacctaccccaggggccctgccaaactacctcaaagtcaaagcaaatcgggctattcctcaagcagtcaccagtacccgtctgggtaccacaaagccaccttgtaccatcacccctccctgcagagcagttcgcagtacatctccacggcttcctacctgagctccctcagcctctcatccagcacctacccgccgcccagctggggctcctcctccgaccagcagccctccagggtgtcccatgaacagtttcgggcggccctgcagctggtggtcagcccaggagaccccagggaatacttggccaactttatcaaaatcggggaaggctcaaccggcatcgtatgcatcgccaccgagaaacacacagggaaacaagttgcagtgaagaaaatggacctccggaagcaacagagacgagaactgcttttcaatgaggtcgtgatcatgcgggattaccaccatgacaatgtggttgacatgtacagcagctaccttgtcggcgatgagctctgggtggtcatggagtttctagaaggtggtgccttgacagacattgtgactcacaccagaatgaatgaagaacagatagctactgtctgcctgtcagttctgagagctctctcctaccttcataaccaaggagtgattcacagggacataaaaagtgactccatcctcctgacaagcgatggccggataaagttgtctgattttggtttctgtgctcaagtttccaaagaggtgccgaagaggaaatcattggttggcactccctactggatggcccctgaggtgatttctaggctaccttatgggacagaggtggacatctggtccctcgggatcatggtgatagaaatgattgatggcgagcccccctacttcaatgagcctcccctccaggcgatgcggaggatccgggacagtttacctccaagagtgaaggacctacacaaggtttcttcagtgctccggggattcctagacttgatgttggtgagggagccctctcagagagcaacagcccaggaactcctcggacatccattcttaaaactagcaggtccaccgtcttgcatcgtccccctcatgagacaatacaggcatcactgagcagaggattcgtgtaggtggcaaagctagatgaggacatgagaataattcaggagaacaaaaggaaacacagaacatgcaaaaggcctgtgcattctagaccagccaattggtgggacagcgtgatgaccggcagggttcaacagaccagggcatcttcttgtgtcttaaacaggcatctctccactgacagccggtgtggtcacttggagcacggctttaataagtcattattatatttttcagcccttcatccagcaaatcagaaggactcagtacaaactccgttatgatatatcctagccacatgcagggtaacatgtaggattttctatattgaaagaatacttttctggcaaaaaaaaaaaaaaaagaaagaaaggaaaacaaaaagcacttttttcttaatggtagcagtataatgtattttgcaacgaatttgtaatttttctgtacgatagttttgataatttatagtactttgatgtcatgtagccattgtatcagttgaagtaatacttgtttactagaggagtttgaacaaagcctttcctacttttttatccctttaagagaaccaatgattctttaggaactttgaatactgaatgactctcaatcaccgtcagctttagtaaaatctctttcttatcctaacaagtgtcttatttggtggaagaagaattaagagtgatggtgatggtgtgcacgtttcattaatccaaccaaaaataatgaaataaaatttgagccacagtataccactccttgggataaagttaaatatttttaaagatcacattttccatgaacgcctctagtagcaaaccattcttttgcacaccacaatgtttccctcagtgccctttctcaaatgggtacaatgttcccttgtggccaaatttccctcccagggagcaatttcagtgctaggatcattggattcagttcccaaaatagaatgtttcagtgagaccatgagaattccaggctcacaaagggagaggagagaacagggcaagacgtttggtttcatttgtcaccatttttaaaactctgtatgctagcacaccaaactcttgtctatatttacctttgtaccacagtattaatcgctattgttcatgtatcgtgctggaagtctgaactgactctagaggatgaattagcaagagggtattttaccaggtatgatctgacttcagttgtgcccatgttataatgtgtttccgacataggagagtcgtgctgctgtctagatcttcttgaatgttgataaaaatgaatgactactacaatacattttgtgttgcttgttggatgaatttgcatgttaactgtaggccaatatagatttgcctttaaaactctggaagagctacatagtcatcattagtttctattaattatgcatcagacaaaagccatttgttaccaaactgggaaaacagaggcttttcttaactatttcacatactgtaacaaatatgaatttaaatttgtgatagcgctctggttgctctaagcataattaagaatttttgtaattaataggttgctaattatttatcactgctaaaaaggaaaaaaggcataaaatgaccttctactgattagattttcagttttctttcaaactggaaatgcctccataaatatgatctatgattttgcttcataaaacagcaaatcaatgttttatgtaaaatattaaagcattaatataaatatgtgagaataaaaacaatctaaatccagaaaatggcagtcctaaatgttcatgagacagattgtattaatttaaccaggactatgtagaagtagaaagaaaagaaaaagaaaatcttttttaaaccagaataaacattaaaaactattgcagaaaatagtggattttggattccaaacattttcgacagtgtaatggaaatttttctgtaattttcttaccatcgggtattttttaaagtattcattgagtttaccaaaagttactgtagcttaaaaggttttgtgagcactaactattggcagaaactgcatttgcaaataaaaataaatgtttgccttttc

SEQ ID NO: 325563 - DNA, 233 bp, Homo sapiens
tctcacgttagtatgaattggtttactcaccctccctccttacaaaaagcttggatttatggactgaaggtgtgcatgaagaaaaggaataaaaagaggatagagtaatcactgactaggaagcactgctttggggaagatctggatgcttagaggcttaaggaaagtgatgaagcaagggaaggtgggaagggacccaaaccaaattttttctttttttttttttttttgag

SEQ ID NO: 325564 - DNA, 285 bp, Homo sapiens
tagctggggctacaggcatgtgccaccatgcctggctaattttttgtatttttagtagagacagggtttcactatgttggccaggctggtctcgaactcctgacctcatgatccgcccgcctcagccacgtaaagtgctgggattacaggtgtgagccaccatgcccggctgaaaggagattcttaaatacacaaaatccttcactccaagggtttagattttttgctcagttttagctgcagactttgctcagtttagagctactagggctttagtttactgtg

SEQ ID NO: 325565 - DNA, 840 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgagtgaacagcagactgcactccagcctgggcaacagagcaaaaactgcatctcaaaaaaataaaaacaaaaaaacagaggggacaccagttcccagcactccaggcctaacttcatagcactcacatcatgtcaagtgagtaaccaaaaatcagtgtacatatgtacacagctatacatatctcacactaagttttctgtaagagttctttttattgcagagac

SEQ ID NO: 325566 - DNA, 812 bp, Homo sapiens
  misc_feature (491)..(491): n is a, c, g, or t
  misc_feature (520)..(520): n is a, c, g, or t
  misc_feature (531)..(531): n is a, c, g, or t
  misc_feature (538)..(538): n is a, c, g, or t
  misc_feature (541)..(541): n is a, c, g, or t
  misc_feature (554)..(554): n is a, c, g, or t
  misc_feature (571)..(571): n is a, c, g, or t
  misc_feature (604)..(604): n is a, c, g, or t
  misc_feature (648)..(648): n is a, c, g, or t
  misc_feature (650)..(650): n is a, c, g, or t
  misc_feature (665)..(665): n is a, c, g, or t
  misc_feature (677)..(677): n is a, c, g, or t
  misc_feature (679)..(679): n is a, c, g, or t
  misc_feature (699)..(699): n is a, c, g, or t
  misc_feature (721)..(721): n is a, c, g, or t
  misc_feature (724)..(724): n is a, c, g, or t
  misc_feature (727)..(727): n is a, c, g, or t
  misc_feature (731)..(731): n is a, c, g, or t
  misc_feature (743)..(743): n is a, c, g, or t
  misc_feature (769)..(769): n is a, c, g, or t
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaacccgcggaggaagaaancagggtggtatgttttgcacctgttcagntcagagtgagnagagagnagnagacaactctctnagctgcgagcggagaanatcgtcatagcgttctgagacacacgtgctcantgacattctctctctgcacattctgtctgtgccaccatgtgtgngntcgcatcatctctcncatcatcatcancncatccatctggggcagcgtncatctctgctcatgctctgctngcnctntctntctttctctctntctctctttgctgtctcggctggcgnctgcacatctctccctgtcacagctctctcttgtgctttgtgc

SEQ ID NO: 325567 - DNA, 488 bp, Homo sapiens
gatttcccactatgcttattccctccgattcttgctgtactctgaagccagagtgaaactttaaagtgtgaaagtgatcataccaataaagtccccattccttaaccttgctacaaggccctcactccagccttaccttgcaccattctcccctcagtctgtaagcttagccataccaaacctttccctgtctctcagtgtgtgtgctttctcacagctgggcctgtgcacagcactggaattacaccatgtgtctgactaacttctcatactcctcattacttcagttatttgcttaaatgccatcttcttagagaggccgccaccagagatgaagccagcctctcccccaccaccaagtaggctttaccttttcttttggaaccttcagtacacctggaattacctatttaaaaatctctcttcctatagcctgcaagctccagaggagaccacatttgtcttgttcattgctataatcccctacg

SEQ ID NO: 325568 - DNA, 3267 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325569 - DNA, 3489 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaaca

SEQ ID NO: 325570 - DNA, 2797 bp, Homo sapiens
ctgtttaaggatcataggattcctttcccccaacccttcacgcaaggaaaaagcaaaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325571 - DNA, 2723 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325572 - DNA, 2177 bp, Homo sapiens
  misc_feature (34)..(34): n is a, c, g, or t
  misc_feature (41)..(41): n is a, c, g, or t
gggcgtcctctagagtagctaattgctgggcctngaccttncacaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325573 - DNA, 2636 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagtgtgtagctgaagctggccgtcgggaaaccgatgcctcatctggaagagcaaacaataaccggacatagagtttatgaaggtctagggaggccccaagactacaggggcgggatggggtcagcataatgcgacataaaaaacaatgccatggcgcggcgaggccacgttcgcagaggggcgtgcagaacacggggggtgagcggcaaatgaatcgcggagaaatccagaaaaaaagggacaccggccccaagcgagaaaaaagggaaa

SEQ ID NO: 325574 - DNA, 1038 bp, Homo sapiens
ttggtaatccctgtgagtacctccagggctataaccggccttcccggtagccctcattgcgcctgggccgttcggccctgaagaatcacgcccacaccatccagatcggcaaacttttgggtgttcaaaaaggcgcgattgttgttgctgaactggcctgtcgggaaacctgaggtcctcatctgggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325575 - DNA, 2086 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggacgcccatcactgcgtgatgctggaatggagcgccggagccaatgcagccgtgggaagcgctcaacgctgatcatctggcgttaatagacgtacctccagggtctggcgggaagaccttgtcgtgagtacgatctgcccagtgcaccagcggctgtctaggagtgatgttctgcactgaatattcatccaccatcggatggccctaagctggtcgtccactcactcatagtgggtcgaactctcactagtgtacccttgcacagaataggtatgtgacgcagcagcaatgcatggaagaggaacgtgctgcaaactcgtatgacgaagcgaagcagcaatcaagctgcatggacgctgaatggccaggtctgggagggtgtcctaccccacatgcaacggcggggaaacaaacacaacggagaggggaaaggcccctgacactctgggcaagtccaggccaggacacagtgtcctggacgggaatcatgagcctagaggattgaacgggaacgtccgcatggggagggctccccctgaaggcatccatgataggcggtccccct

SEQ ID NO: 325576 - DNA, 926 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggttaagggctcccggagggttaaggggtcccggagggttaagggctcccggagggttaagggctcccggagggttaagggctcccggagggttaagggctcccggagggttaagggctcccggagggttaagggctcccggagggttaagggctcccgg

SEQ ID NO: 325577 - DNA, 856 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggtgacagtggtggctcgatcagtcactctcactccatttaacaccttctggccatggtggagtaatttcccgcttttaaactagctcttctcggtctgtcttacttatactgttaaaatcatctttttagaatacatgcccaggctgggcacagtgggtcacgcctgtaatcccagcactttgggaggccgaggtgggaggatagcttaagcccaggaatttgagacctgcacactccattctccacaaa

SEQ ID NO: 325578 - DNA, 321 bp, Homo sapiens
gtgagtgagctgggctgtgggaaaagggataagggtaacagtaatggaagacgggagttgcagtgctcagtcatggaattcctcctatgtaggacgagccaaccaataacctggacatagagtctattgatgctctaggggaggccatcaatgaatacaagggtggtaagtcagctgagagtgtgccctcatccctgctccatggggaccaagctgtagtgtccttcactacagaagggcctaggactcccttatttcatgttctgattcccctctttctcctttcttcctgccctctgttgttgctatctttcttcaaag

SEQ ID NO: 325579 - DNA, 520 bp, Homo sapiens
accaccaagtaggctttaccttttcttttggaaccttcagtacacctggaattacctatttaaaaatctctcttcctatagcctgcaagctccagaggagaccacatttgtcttgttcattgctataatcccctacgctagcacaatatctgacacatggtagctgtttagtagatacttagtggatgaatgaatagagatgggaatgattatttctgcaggagttgtgagacagtacaaatatttaaggagtgatagttaagctagaaaaataataaaataggatagaggctacagagatctttgcaggggggatcagactgctttggaatttgcagataagcattcacgatgtccgcttaactttctagacaaagtggtgaagaaagggaagaaggacaagaagatcaaaaaaacggtgagaaaatgagggttgaggataagaaatgactatggatgtttccaagctaaataaatagccatgtgaaggaggtgggaggtccaagggaggagaaaagat

SEQ ID NO: 325580 - DNA, 432 bp, Homo sapiens
tgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325581 - DNA, 3153 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325582 - DNA, 946 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaagcagcggggggcctagcccttactagtctcaatctccaacacattatggcctagactacgttacataacctaaaccttactccaagtgctaaaactaattcgtcccaacaattatattactaccacgtgacattgactttccaaaaaaacacataattggaatcaacacaaccacccacagcctaattattagcatcatccctctactattttttaaccaaatcaacaacaacctatttagctggttccccaaccttttcctccggaccccctaacaacccccctcctaatactaactacctgactcctacccctcacaatcatggcaagccaaggccacttatccagggaaccactatcacgaaaaaaactctaactctctatactaatctccctagaaatctccttaattataaccttcacaggcacagaactaatcatatttgaaatcttccttcggaaccacattttcccacctgggggtataatacccgatgagggagacaggcgaaagcgcgtaaacaaggacattttccaattttaccctagaaggggcctatccaataacggggaaattatatcaaaaca

SEQ ID NO: 325583 - DNA, 3386 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 325584 - DNA, 3220 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325585 - DNA, 3522 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggagggggagtggcatctcctggagcagctacgttgctgtcacgaagaggaactgtcatcaacatctccgatcacccccctctgactcgcttgtgtccccagaatccacccccattcagaggcctgagcaatatggtccagtacctcggacgtatgaagggcgcaaggggtccgcagggtgggcacttgtcagaaacctccactgtgtctggccaattctcttcacagccccaccgatgggtgcttcccagatccacatccgtgggaaagaaccccgcgtgtggcgagttacacaaaccccgagaaccccaagtgtctctcagcgctcaccgacagtcgtcacccggtacaccgccccgcgaggtcccgcccgagtgacagatccacgtaagttgctcccggccggggcc

SEQ ID NO: 325586 - DNA, 2879 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccatcgcgagcagcggtgtttcagacacgagaccgtgaaatgaccggcatcccacctgcgagtacacccacttctcagatagactgattcgctctcctgccttctcatcatattac

SEQ ID NO: 325587 - DNA, 1142 bp, Homo sapiens
cagtggactcggccgctgacttaacccatggggaaataagaaagaaccacaggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccga

SEQ ID NO: 325588 - DNA, 1230 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcaggttcagaggaagaacggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggacttttaggtcggtcaagaccggtgtgcctgatgttactctggagggccaggtgtacccccggtcaaaagcgagcgaggtacagcaaacgagaacaactacaacatagtccaagacaagggccaataaaactatataatg

SEQ ID NO: 325589 - DNA, 755 bp, Homo sapiens
agcccgggggcggggttggccgcgccagacttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaagaagggccacaatgttgaagtggcagtggcacccaggagttagggacccccttccagctctggcatagaagagttatcacatacctgagatcctaacaaggt

SEQ ID NO: 325590 - DNA, 2334 bp, Homo sapiens
gaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattc

SEQ ID NO: 325591 - DNA, 687 bp, Homo sapiens
  misc_feature (9)..(9): n is a, c, g, or t
  misc_feature (24)..(24): n is a, c, g, or t
ctcgtcaanttcgagcaggagttntctaatgattgtagaacttgaattgctctagaatgtgaatgactacccttgtgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattc

SEQ ID NO: 325592 - DNA, 594 bp, Homo sapiens
  misc_feature (54)..(54): n is a, c, g, or t
aacttaaactattagtattaaataagatactggcatagtaaatactctaatatntttcactaaagtcagggaagtaaccaaacaatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattc

SEQ ID NO: 325593 - DNA, 1793 bp, Homo sapiens
gaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagtgtcctgttaactcttgagtgctaagtagatctttgcaacagtaagcttgattgatcatgggttaaaaagagagaatattgaaatagatgttttaatacaggctggaaatcagctattcaacactatcattgatttagtatacaagaaatcatatggattaactgaacttaatagtactcaagtaggatatgcaaaatttatattttacataatctgtgaacatttttagtacctaaaaatgtttcaggtatttcaaagatgggaacaaccagtatctagtcatcatacattaatgtgaacatgcttattaaaagttaacctctttataaaaagtattaataaaccaagatgtgcctaaatattagggtacttcaagctaaaggtcatagtttatatataaaaagtacgagattcaaggaagtaatgtatctgatgctttgcttaataagattcactagtgcttgcccttaattcatagaacagtattgtttaggttacattaacctgaaatttaaagcataattattaggattccggcctataaatacaataattaaaatctatactatattattgctaccatgaaagtcttatctttggctgtttttcaagtagaaaagtaagtgtactgtgagccttttatttgagatgctgagagctattaggatgagtatttcagttttcttgtcaatagtgatactctgatgatgttgcagttatttgaagtagaactgattgtctaaaccagacacacataggagtgtgctccattggtcttgtggagagtgctgcacattaacccctccctcaactgtgcaatccacttgagactggcttctctaagccacagttgttatctgctgtgtaaagtcctggatgccagcactgtggcttcttagagagggcagatgctttgtatatcgagctgcagcattcatcgtagaaaatgctacaaagctgtctctcttccccttctctcatgtttccctcttttcatcaagatgaaggctgttgggtaagaaaaactaagtgatttaacaaatcattatgatttaaacttagaaataaacctagaattttttggtgtcccttttatcataggtgtttaatgtatattttaatgattgtagaacttgggttgatgagaagaatgtgcagaaacataactgagagagcgggttggttttggggttttttttgttgaggatctcttgtgaggagttctttgcaaaaaaaaa

SEQ ID NO: 325594 - DNA, 252 bp, Homo sapiens
tgaatgcctctgtcatcttttgcaaagaaagataatttaaaaagtacaaaacttaagaacaaattgtttaggtctaacaggttatgaaggtggcagtgagacatttcaaagctggaatatatacaacgtttgagttttgtttaggttcctctttggttcagtaaattaggaaagggatgcatttggcagggtgggaataaagcagaaatgaaacaattctacttaaaataattattttcccagttcatctac

SEQ ID NO: 325595 - DNA, 2141 bp, Homo sapiens
agcggggggtacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325596 - DNA, 2059 bp, Homo sapiens
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325597 - DNA, 2271 bp, Homo sapiens
  misc_feature (2077)..(2077): n is a, c, g, or t
  misc_feature (2088)..(2088): n is a, c, g, or t
  misc_feature (2090)..(2090): n is a, c, g, or t
  misc_feature (2096)..(2096): n is a, c, g, or t
  misc_feature (2099)..(2099): n is a, c, g, or t
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagttaaaaaaaaaaaaaacaanaacaaacaaananacaaanaanacaacaagaacaaacaacaagaaaaaacaaaagaacaagaaaaaacaaccaaaaaagcagcaaagagagcaaaaaacacaaacaacaagccacaaaacgacaacgggacacacgagaaacctgaagaaacggaccaacaccagaagacagaaccaagaaaggagagagaaag

SEQ ID NO: 325598 - DNA, 2195 bp, Homo sapiens
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtttcaaaccgcttcctcaacctatgtaacatctactctctctctggggggggtctggtaaacatctcttcctccaggttggggcgtcttcaaaattcaccgggggctcggtttaaaacccgtcctcaaaattgcgaaa

SEQ ID NO: 325599 - DNA, 1677 bp, Homo sapiens
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacactttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325600 - DNA, 2162 bp, Homo sapiens
  misc_feature (1968)..(1968): n is a, c, g, or t
  misc_feature (1979)..(1979): n is a, c, g, or t
  misc_feature (1981)..(1981): n is a, c, g, or t
  misc_feature (1987)..(1987): n is a, c, g, or t
  misc_feature (1990)..(1990): n is a, c, g, or t
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagttaaaaaaaaaaaaaacaanaacaaacaaananacaaanaanacaacaagaacaaacaacaagaaaaaacaaaagaacaagaaaaaacaaccaaaaaagcagcaaagagagcaaaaaacacaaacaacaagccacaaaacgacaacgggacacacgagaaacctgaagaaacggaccaacaccagaagacagaaccaagaaaggagagagaaag

SEQ ID NO: 325601 - DNA, 1507 bp, Homo sapiens
cagagttaccaatcttatgagtagcgtcatattaacttacctgaagctgacttcatgcaagtgtcggatgaatatctttattaacgatgcagacggcatagtgatgaaaacttgaattagatatcttgagcagttatgtttgaaatattttactgaacgttgagaagttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325602 - DNA, 1255 bp, Homo sapiens
tgttgtgccaggcgtgcggtgttcgtcgcatcgcgcgacgggtttcctcctggctgacgttccttattcgtgtacaagctccgtcgcgattttcctggccctctctatttacaaggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325603 - DNA, 1002 bp, Homo sapiens
  misc_feature (966)..(966): n is a, c, g, or t
  misc_feature (971)..(971): n is a, c, g, or t
agcggggggtacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagactcctttgcagngatanagggtctttgatgtgacactttcaagaccag

SEQ ID NO: 325604 - DNA, 672 bp, Homo sapiens
atgccatagaagtgttttatttgttttgtttatgtttgtttgaggcagggtctgtgctgcttacattacagtattgtttaattcctgacccctggtggttcacaggtgaaggttgtcatcctgggacaggatccatatcatggacctaatcaagctcacgggctctgctttagtgttcaaaggcctgttccgcctccgcccaggtacagttgctttacaggtgactgcagtccagacatgattcctttcagatgtgtacttagcttattacaagtgggactatctggggcactgttcactagccttggaggaggatttctcggcctcagcaccattgacatttggggctgagtcattctttgttgtggaggaggagaggagtcctgtgctattgcaggatcttgtgccacatccctggcctctaccactggaaaccaggagcaacccccagctcgtgataatgaaaaatgtgcagacattgccaaaagtcccttgggggcgtaaaatcacccctggttaagaaccactgctttgggccgggcgcggtgactcacgcctgtaatcccagcactttgggaggctgaggcaggagaatcgctggatcccgggaggcggaggtggcagtgagccgagatcctgctactgcactctagcctgggtgacacagcaaga

SEQ ID NO: 325605 - DNA, 777 bp, Homo sapiens
  misc_feature (19)..(19): n is a, c, g, or t
  misc_feature (41)..(41): n is a, c, g, or t
  misc_feature (761)..(761): n is a, c, g, or t
  misc_feature (765)..(765): n is a, c, g, or t
acggtcagtaccccccggnttatgtagcgaggctgggtggngcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgtctcttctcagcgtctcacggtcgtgccataagcaantctnaggggagtggag

SEQ ID NO: 325606 - DNA, 2064 bp, Homo sapiens
  misc_feature (19)..(19): n is a, c, g, or t
  misc_feature (41)..(41): n is a, c, g, or t
acggtcagtaccccccggnttatgtagcgaggctgggtggngcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325607 - DNA, 2082 bp, Homo sapiens
agcggggggtacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325608 - DNA, 2092 bp, Homo sapiens
agcggggggtacgcggtggggcgggtctggcgggggcggggcacctctgtgcagggttcccagtcaccgcgacgctcctcgggaagccatagggcgcctcccagcccgtctccccgctccagtttagaacctaattcccaattcccggaccgggcccagccctgggctcttactgtccgcttttgctgggacctgttccacaaatgggcgtcttctgccttgggccgtgggggttgggccggaagctgcggacgcctgggaaggggccgctgcagctcttgagccgcctctgcggggaccacttgcaggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggttaagattgctgtgagctttatcagataagagaccgagagaagtaagctgggtcttgttattccttgggtgttggtggaataagcagtggaatttgaacaaggaagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325609 - DNA, 1950 bp, Homo sapiens
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgtttttgcttagaaaggtccccttgtctcagccttgcagggcaggcatgccagtctctgccagttccactgcccccttgatctttgaaggagtcctcaggcccctcgcagcataaggatgttttgcaactttccagaatctggcccagaaattagggctcaatttcctgattgtagtagaggagaaaagggaattttgtctttatggggtggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325610 - DNA, 1735 bp, Homo sapiens
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgttctccttctcaacgctgtcctcacggttcgtgcccatcaagccaactctcataaggagcgaggctgggagcagttcactgatgcagttgtgtcctggctaaatcagaactcgaatggccttgttttcttgctctggggctcttatgctcagaagaagggcagtgccattgataggaagcggcaccatgtactacagacggctcatccctcccctttgtcagtgtatagagggttctttggatgtagacacttttcaaagaccaatgagctgctgcagaagtctggcaagaagcccattgactggaaggagctgtgatcatcagctgaggggtggcctttgagaagctgctgttaacgtatttgccagttacgaagttccactgaaaattttcctattaattcttaagtactctgcataagggggaaaagcttccagaaagcagccatgaaccaggctgtccaggaatggcagctgtatccaaccacaaacaacaaaggctaccctttgaccaaatgtctttctctgcaacatggcttcggcctaaaatatgcagaagacagatgaggtcaaatactcagttggctctctttatctcccttgcctttatggtgaaacaggggagatgtgcacctttcaggcacagccctagtttggcgcctgctgctccttggttttgcctggttagactttcagtgacagatgttggggtgattttctcctagggttatgtccagttggggtttttaaggcagcacagactgccaagtactgttttttttaaccgactgaaatcactttgggatattttttcctgcaacactggaaagttttagttttttaagaagtactcatgcagatatatatatatatatttttcccagtcctttttttaagagacggtctttattgggtctgcacctccatccttgatcttgttagcaatgctgtttttgctgttagtcgggttagagttggctctacgcgaggtttgttaataaaagtttgttaaaagtt

SEQ ID NO: 325611 - DNA, 772 bp, Homo sapiens
  misc_feature (756)..(756): n is a, c, g, or t
  misc_feature (760)..(760): n is a, c, g, or t
cgacgcacattaaggctaggtacgaggccgggtggtgcaggctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggattttgttcatcctggccatggagatttatctgggtgggccaagcaaggtgtctcttctcagcgtctcacggtcgtgccataagcaantctnaggggagtggag

SEQ ID NO: 325612 - DNA, 361 bp, Homo sapiens
agctaaggatccagttaggacctggaacatctgggcaggtgggaaggaggagtcataaggtctgcagacagtgagtgactctcccatgctgccttgggcaaattctaagcatcgctgcaccaagagagactctgagatctccaataaatgcaaccttaatcaatacaacacgaggctcaagcctggggtgctgctgccatgcccttccgagctgggtatctgccaagtttccaccatgtgcctcaaaacaaaggggcctccagaagctttctgcttataacttgtgcatgcctttggtaagagatgttcaaagtctaccctcttccaaaacaaagaggacttccagaataggcatccagcc

SEQ ID NO: 325613 - DNA, 3478 bp, Homo sapiens
  misc_feature (1841)..(1841): n is a, c, g, or t
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatantaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactctttcgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccct

SEQ ID NO: 325614 - DNA, 5142 bp, Homo sapiens
  misc_feature (1841)..(1841): n is a, c, g, or t
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatantaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactctttcgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaacaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatatgtacatctactccttggaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaagggaaggaagatgccattacttggtgtatttatgatgggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgca

SEQ ID NO: 325615 - DNA, 4158 bp, Homo sapiens
  misc_feature (1841)..(1841): n is a, c, g, or t
  misc_feature (4094)..(4094): n is a, c, g, or t
  misc_feature (4122)..(4122): n is a, c, g, or t
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatantaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactctttcgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaacaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatatgtacatctactccttggaaaaagtattctggtggtggtgtggctaatgattgacaaatatttctgtaaaatttctgcctgccttgggccttccnggggtgctgggggattacggggcctggngccaccgcgcccgggcctggcccccttttcccagga

SEQ ID NO: 325616 - DNA, 135 bp, Homo sapiens
aagaatcaatgtagataatgtgatttgggatttatagttaccatataaatagaagttgatgtaacatatcatgggttacttcttatgtcgaagttaaaaagattaactaagcaggatatacatgttttacaccag

SEQ ID NO: 325617 - DNA, 324 bp, Homo sapiens
tgttaggaaaaaagcattgcctgacagcggtgaagatcgagatacaaaagaagctctaaaggagtttgacttcttggttacatcagaggaaggagacaatgaatctagaagtgcaggcgatggaacagactggggtaaggaagcatactggatccaaccagagatgttaagtaaataaaagaaattaatattttaccaggagggcaacatcttaactataatgttgaaatattgagcattctgtgaacttattactactagcaccctttatccagggtgaatgtgtgtgtatgtttaaggaacattgtataactacctcattta

SEQ ID NO: 325618 - DNA, 5633 bp, Homo sapiens
  misc_feature (1841)..(1841): n is a, c, g, or t
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatantaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactctttcgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaacaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatatgtacatctactccttggaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaagggaaggaagatgccattacttggtgtatttatgatgggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgcaaaatatttcgcttttataatcattttagttatgactaaaacgggggaaattgagctgcatcactgatgatgaactttgtgagaaattttttttttaatctgactttcattccttcagtattcttgctataaatttcttttggagataatgatgaagatttatttgaaaatgtctaaaatgtatgtatattttataaatatatattatatatattgtaagaatatatataatatataaactatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcattataggctagcatgcttgttttaaagactgtcattctagtgtattaaaatctgaatgtaagaaaaaaaaaaaa

SEQ ID NO: 325619 - DNA, 5044 bp, Homo sapiens
  misc_feature (1252)..(1252): n is a, c, g, or t
tctccttcagcacggcgtggtgtgtccctggacacagctcttcattccattgacttagaggcaacaggattgatcattcttttatagagcatatttgccaataaagaaggacttgagtttccttctttattgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatantaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactctttcgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaacaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatatgtacatctactccttggaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaagggaaggaagatgccattacttggtgtatttatgatgggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgcaaaatatttcgcttttataatcattttagttatgactaaaacgggggaaattgagctgcatcactgatgatgaactttgtgagaaattttttttttaatctgactttcattccttcagtattcttgctataaatttcttttggagataatgatgaagatttatttgaaaatgtctaaaatgtatgtatattttataaatatatattatatatattgtaagaatatatataatatataaactatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcattataggctagcatgcttgttttaaagactgtcattctagtgtattaaaatctgaatgtaagaaaaaaaaaaaa

SEQ ID NO: 325620 - DNA, 8599 bp, Homo sapiens
gagagcgagagtgagtgagtgtgagtgcggggtggggtggtggccgttacgttcggggcaacggctacggcagtggagaagtaagaagagaaacaacgtccggcgcttccgccttcgcttaggaggaggaagagctggtagggaaaggaaagtgcttcgccctgggcctggactggaccgagtcgggttggtgggggtctgggctatgagcttttgagggtcgcctgggacgcggagcgagacacgagagccaggagctatgtctcagccgccgccgccgccgcctccgttgccgccgccacctcctccccctgaggctccacagactccgtcgtccttggcgtcggcggctgcttcgggggggcttttgaagcggagagaccggagaatcctttccgggagctgcccggatccgaagtgtcaggcgcgtctatttttcccggcctccggttctgtcagcatcgagtgtaccgagtgcggccagcggcacgagcagcaacagctgctgggggttgaggaggtgaccgacccggacgtagtgctacacaacctgctgcggaacgcgctgctcggggttacgggggcacccaagaagaacacggaactggtaaaggtgatgggcctttccaactatcactgcaaattgttgtcgcccatattagctcgctatggaatggacaaacagacaggccgggccaagcttctccgggacatgaaccagggcgaactgttcgattgcgccttactgggtgaccgcgccttcctcatagaaccagagcatgttaacactgtgggctatggcaaggaccgctccggaagcctcctgtatttgcatgacactctggaggacattaagcgggccaataaaagccaggaatgtctcattccagtgcatgtggacggggatggacactgcttggtgcatgctgtgtctcgggctctagtaggccgagagctcttctggcatgccttaagagagaatcttaaacagcactttcagcagcacctggcccgatatcaagctctgttccatgacttcattgatgctgctgagtgggaggacattatcaatgagtgtgaccctctgtttgtaccacctgagggtgttcccttgggcctgaggaatatccacatatttggtcttgccaatgtgctacatcgtcctattattctgttagattccctcagtggcatgagaagctctggtgattattcagccacctttctacctgggctcatccctgcagagaagtgcactgggaaagatggtcatttgaacaaaccaatctgtattgcatggagcagctccggtagaaaccattatatccccttggtaggcataaaaggggctgctttgcccaaactgcctatgaatttgcttcctaaagcatggggtgtgcctcaggaccttattaaaaagtacataaaacttgaagaggatggtggttgtgttattggaggtgacagaagtttgcaagataaatacttacttaggcttgttgctgctatggaagaagtctttatggacaaacatggtatccatcctagtttggttgctgatgtccatcagtatttctacagaaggactggagtgataggagttcagcctgaggaagtcacagcagctgctaaaaaagcagtaatggataatcgccttcacaaatgtttgctctgtggtgccctttctgaacttcatgttcctccagagtggttggctcctggagggaaattgtataacctggcaaaaagtactcatggacagctgaggactgacaaaaattacagctttcccttgaacaatttggtttgctcatatgattcagtgaaagatgttctggtaccagactatggaatgagtaacctaacagcttgtaattggtgccatggcacatctgtgcgaaaggtcagaggagatgggtctattgtgtatttggatggagacagaactaattctaggtccactggtggcaaatgtggttgtggattcaaacacttttgggatggtaaggagtatgacaatctaccagaagctttccctattactttagaatggggtggaagagtggtcagagaaacagtatattggttccagtatgaaagtgattcatctttgaatagtaatgtttacgatgttgcaatgaaacttgttaccaagcactttccaggtgaatttgggagtgaaatcctagttcagaaagttgtccacactatattgcatcagactgccaaaaagaatcccgatgattatactcctgtaaatatagatggtgctcacgcccaaagagttggagatgttcaaggacaagaatcagagtctcagctcccaactaaaattattcttactggacagaaaacaaaaactttgcacaaggaggagttaaacatgagtaaaactgaaagaactattcaacagaatattacggaacaggcttctgtaatgcagaaacggaaaacagagaagttaaaacaagaacaaaaagggcaacccaggactgtttctcccagtaccattcgtgatggtccatcctctgcacctgctacacctaccaaggctccctattcaccgacaacttctaaggagaagaagatccgaatcacaactaatgatggacgacagtccatggttacccttaagtcttcaacaaccttttttgaacttcaggaaagtatagccagagaattcaacattcctccatatttacagtgtattcgatacgggtttcctcctaaagagttaatgccaccacaggcaggaatggaaaaggaaccagttcctttacagcatggcgacagaattacaatagaaattctaaaaagtaaagctgaaggtggtcagtctgctgcagcacactcagcccacactgtgaaacaagaagatattgctgttactggtaaactgtcatctaaggaacttcaggagcaagctgaaaaagaaatgtactccttgtgtcttttagcaacattaatgggagaagatgtatggtcttatgcaaagggacttcctcacatgtttcagcagggtggtgtattctacagtattatgaagaaaaccatgggtatggctgatggcaagcattgtacttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtactgaaaatttgaatacagaaacaactgatggctgtgtagcagatgcactgggagcagcctttgccacaaggtcaaaagcacaaaggggaaattccgtggaggagcttgaagagatggatagtcaagatgctgagatgactaacacaactgagccaatggatcactcttgatttaattagaggctaataaaggcagaatgtttattgtgaatatgtaatatttgttggctgggccacgtaacttgattagtcattaaaaatcttgtacgtatataattcaaagattatatcttgttattcagtgcatgatagcaagtgtgtgattggccatagcttttaatatactgctgcccaggctggctctgaatttctataaattagctgttagatctgctgagatgactttcttccatatatgtggttcattggaagttctttgtaattttaattccatgaaagtcttaatgtttccaacatgaaaattctcttacttaaatacgtttgatttctgaaaagcctacaaatggaggggaaatgagattgtgctaatgttgatgtcatcaaggtaaccatctcatatactagtgtcaaaaggtttatgtaaacttgaattttatctgaactaaattgtatcttaaaattcatacaattatttattagacagtggaatgcaaatgtttctatgaacgtaaacacattcatagagatttcttggcgaaaatatcttgagaatagaatgtaacgatataacattttgctgatttgtgcaagattggggaaaaatttcttctagattgatgaggtcaatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaatatatgttaatacaatctcttacctagagcattcaaagcctggctgtctctgtttgcacatgtaacagatgcagaactgtgtttgtaattctaagaaaatgtatgtcagaaagtattttatcagatgtttaaaaatctctgcctgttgattcataagggatatagacagtactttaacttgtgtttccagataaggcagattttggtcatctttctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagatggacttaatctctgacaactttattaatttctctagctacagcaatgctatttaaaagccagttaggtatgaatagtacagtaatagtttgggttctcccttgataaatgaataaaaggctcaattctgataagtgatcaaatttcttgaaattctttcaaatcagctgaaaatttggttggggtgaattgatggtttttgagaagtaggccaggtatcctcacaaagaagttttagaatagggtttcttttaagtttttaaatatcatcctttgtctttccatatggttttcataaccaaatacatgactatagcatggttatttttctagtactgccatttgtgatatagccacatcttggcgtgcaagctagacatctcaggtaaatttgtttttttttttttttttagccctagaggtaacattataactaaaatgcattcctgcaattctgtttgcagtgcttcactaaacattgaaataaagttgtaaattttttcttcagtaatccattttatagttaatcataccaaatttaagttgatgacctaaagtccaggtagtgttgaagatagtatgtatctagaatactggtaatgagaaattgttgtaaattgaagaaaacaagatgctgccatatattaagatagaatataattaactccatgagaatggttactcaggaactagttaaagagcaaacccatttctcccgcttcactctgtttcagatatttttattggaaaatgttagggtagaggcctgagaaagttagcaaatgctattgactgatactggctctgtgtcttccagtgatttttagtttggtttttacagtcaagcctactgcttgcaattaagatatcaatctgaaatgcatctgtaattcctggccacaggtccttattgccattatttttaagtatcttcattggagatgaacactgacttttgcatatggtctcttacctcagggaagatcacttgctagcaactcatactactaatgacaggtttttgagaattgtactgacatcacatgttagctactaaatgcaaaatgtataaaagtattgttttatgtagttacctaccaatactatctgctactgaataactctctaaatatgtagacctcactaataactaacctttaggtaaaaaatttacttctgtcattaattacacttcaactggtcaatatagtggcagcataaagtgtttatttcagaatatcaatacagttttgtcttcatttttcaacagtaatttcaattggttcatacttaaaatactacacagattttgagttttatggttctcaaagcaaggtttccatcttaagatttttataaacacaaagcctttgcaaaattggattaaattccacctatcttaatgtgaattaaaaaccaccatttataataataatagcgccatattctaagttgagtaaatgcatcctaccattcaaggttatcatataatttaacaaaattgtacaaccttaaggctcttcacagtataaattaatttttcaaaccagagctgttcacatgaaaatattccttagtagaatgtatatttaagaaataaaacaacaaaggggaactatatcacccatgtaagttatagagttaattacaagttctaccattcttgataattctttgagatgctaagtgtttcagttcatatttaatgatacttaaatcgtgggaattttaatgtttgttccaaaatagcagaaattgtaaaaattatgaattattggagaaaatgccattacttgtatatctgacatttaattttttaattatggagactacatgcttttgtagtataatattaatgattattctcttgtaaaagaaaaggaaaaattagtaaagaaaaaagttttagttgatgttacctgcttgtgagtatcaattacttagtttttaaatttttaaggtattgcctacttttctttagaatgcagaaatctcgtcctgagcccttattatgcctgtggtagagcaatgcaagactgaaaaggttgccagtattttcaggcttatttgactaagaattagtgccaagaactggaaagtctactttttggagggaaatgatacttagaatttgtaaacataagcagtaatagtgtaaatatttagaaaaatagcaagtgctttaactgctcaataaaatagtatagatgttatttcacccttaaggcactggctgttgcccattattttccgatttcgtgattactgtatatattacatttgagtaatgaataattggtaatagtgtattatagtgttctacagcacaccttactgtacagtatttgaagttttcttttatatcaataataaaactataagttaatactgattttcccctgaaattctccacattagcttttaaaggtaattttatgttctttagtttcctggaattataatgcatgaacatatagttcagttttataaagaaattcttaaataataaagttttcttgttgaacttaaaaaaggaaaaaagaggaagagagaaacaaagaagaaaaaaaaaagaaagaaaagaaagaggaaaagaagaaaagagagagaagggaagggaaagacaaggagaaaaaaaagaagagag

SEQ ID NO: 325621 - DNA, 5596 bp, Homo sapiens
cgaggccgtgggagactcaccgccaccgcgtgatggagagtttatgcgtttaggtatggctgatggcaagcattgtacttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtactgaaaatttgaatacagaaacaactgatggctgtgtagcagatgcactgggagcagcctttgccacaaggtcaaaagcacaaaggggaaattccgtggaggagcttgaagagatggatagtcaagatgctgagatgactaacacaactgagccaatggatcactcttgatttaattagaggctaataaaggcagaatgtttattgtgaatatgtaatatttgttggctgggccacgtaacttgattagtcattaaaaatcttgtacgtatataattcaaagattatatcttgttattcagtgcatgatagcaagtgtgtgattggccatagcttttaatatactgctgcccaggctggctctgaatttctataaattagctgttagatctgctgagatgactttcttccatatatgtggttcattggaagttctttgtaattttaattccatgaaagtcttaatgtttccaacatgaaaattctcttacttaaatacgtttgatttctgaaaagcctacaaatggaggggaaatgagattgtgctaatgttgatgtcatcaaggtaaccatctcatatactagtgtcaaaaggtttatgtaaacttgaattttatctgaactaaattgtatcttaaaattcatacaattatttattagacagtggaatgcaaatgtttctatgaacgtaaacacattcatagagatttcttggcgaaaatatcttgagaatagaatgtaacgatataacattttgctgatttgtgcaagattggggaaaaatttcttctagattgatgaggtcaatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaatatatgttaatacaatctcttacctagagcattcaaagcctggctgtctctgtttgcacatgtaacagatgcagaactgtgtttgtaattctaagaaaatgtatgtcagaaagtattttatcagatgtttaaaaatctctgcctgttgattcataagggatatagacagtactttaacttgtgtttccagataaggcagattttggtcatctttctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagatggacttaatctctgacaactttattaatttctctagctacagcaatgctatttaaaagccagttaggtatgaatagtacagtaatagtttgggttctcccttgataaatgaataaaaggctcaattctgataagtgatcaaatttcttgaaattctttcaaatcagctgaaaatttggttggggtgaattgatggtttttgagaagtaggccaggtatcctcacaaagaagttttagaatagggtttcttttaagtttttaaatatcatcctttgtctttccatatggttttcataaccaaatacatgactatagcatggttatttttctagtactgccatttgtgatatagccacatcttggcgtgcaagctagacatctcaggtaaatttgtttttttttttttttttagccctagaggtaacattataactaaaatgcattcctgcaattctgtttgcagtgcttcactaaacattgaaataaagttgtaaattttttcttcagtaatccattttatagttaatcataccaaatttaagttgatgacctaaagtccaggtagtgttgaagatagtatgtatctagaatactggtaatgagaaattgttgtaaattgaagaaaacaagatgctgccatatattaagatagaatataattaactccatgagaatggttactcaggaactagttaaagagcaaacccatttctcccgcttcactctgtttcagatatttttattggaaaatgttagggtagaggcctgagaaagttagcaaatgctattgactgatactggctctgtgtcttccagtgatttttagtttggtttttacagtcaagcctactgcttgcaattaagatatcaatctgaaatgcatctgtaattcctggccacaggtccttattgccattatttttaagtatcttcattggagatgaacactgacttttgcatatggtctcttacctcagggaagatcacttgctagcaactcatactactaatgacaggtttttgagaattgtactgacatcacatgttagctactaaatgcaaaatgtataaaagtattgttttatgtagttacctaccaatactatctgctactgaataactctctaaatatgtagacctcactaataactaacctttaggtaaaaaatttacttctgtcattaattacacttcaactggtcaatatagtggcagcataaagtgtttatttcagaatatcaatacagttttgtcttcatttttcaacagtaatttcaattggttcatacttaaaatactacacagattttgagttttatggttctcaaagcaaggtttccatcttaagatttttataaacacaaagcctttgcaaaattggattaaattccacctatcttaatgtgaattaaaaaccaccatttataataataatagcgccatattctaagttgagtaaatgcatcctaccattcaaggttatcatataatttaacaaaattgtacaaccttaaggctcttcacagtataaattaatttttcaaaccagagctgttcacatgaaaatattccttagtagaatgtatatttaagaaataaaacaacaaaggggaactatatcacccatgtaagttatagagttaattacaagttctaccattcttgataattctttgagatgctaagtgtttcagttcatatttaatgatacttaaatcgtgggaattttaatgtttgttccaaaatagcagaaattgtaaaaattatgaattattggagaaaatgccattacttgtatatctgacatttaattttttaattatggagactacatgcttttgtagtataatattaatgattattctcttgtaaaagaaaaggaaaaattagtaaagaaaaaagttttagttgatgttacctgcttgtgagtatcaattacttagtttttaaatttttaaggtattgcctacttttctttagaatgcagaaatctcgtcctgagcccttattatgcctgtggtagagcaatgcaagactgaaaaggttgccagtattttcaggcttatttgactaagaattagtgccaagaactggaaagtctactttttggagggaaatgatacttagaatttgtaaacataagcagtaatagtgtaaatatttagaaaaatagcaagtgctttaactgctcaataaaatagtatagatgttatttcacccttaaggcactggctgttgcccattattttccgatttcgtgattactgtatatattacatttgagtaatgaataattggtaatagtgtattatagtgttctacagcacaccttactgtacagtatttgaagttttcttttatatcaataataaaactataagttaatactgattttcccctgaaattctccacattagcttttaaaggtaattttatgttctttagtttcctggaattataatgcatgaacatatagttcagttttataaagaaattcttaaataataaagttttcttgttgaacttaaaaaaggaaaaaagaggaagagagaaacaaagaagaaaaaaaaaagaaagaaaagaaagaggaaaagaagaaaagagagagaagggaagggaaagacaaggagaaaaaaaagaagagag

SEQ ID NO: 325622 - DNA, 4296 bp, Homo sapiens
gagagcgagagtgagtgagtgtgagtgcggggtggggtggtggccgttacgttcggggcaacggctacggcagtggagaagtaagaagagaaacaacgtccggcgcttccgccttcgcttaggaggaggaagagctggtagggaaaggaaagtgcttcgccctgggcctggactggaccgagtcgggttggtgggggtctgggctatgagcttttgagggtcgcctgggacgcggagcgagacacgagagccaggagctatgtctcagccgccgccgccgccgcctccgttgccgccgccacctcctccccctgaggctccacagactccgtcgtccttggcgtcggcggctgcttcgggggggcttttgaagcggagagaccggagaatcctttccgggagctgcccggatccgaagtgtcaggcgcgtctatttttcccggcctccggttctgtcagcatcgagtgtaccgagtgcggccagcggcacgagcagcaacagctgctgggggttgaggaggtgaccgacccggacgtagtgctacacaacctgctgcggaacgcgctgctcggggttacgggggcacccaagaagaacacggaactggtaaaggtgatgggcctttccaactatcactgcaaattgttgtcgcccatattagctcgctatggaatggacaaacagacaggccgggccaagcttctccgggacatgaaccagggcgaactgttcgattgcgccttactgggtgaccgcgccttcctcatagaaccagagcatgttaacactgtgggctatggcaaggaccgctccggaagcctcctgtatttgcatgacactctggaggacattaagcgggccaataaaagccaggaatgtctcattccagtgcatgtggacggggatggacactgcttggtgcatgctgtgtctcgggctctagtaggccgagagctcttctggcatgccttaagagagaatcttaaacagcactttcagcagcacctggcccgatatcaagctctgttccatgacttcattgatgctgctgagtgggaggacattatcaatgagtgtgaccctctgtttgtaccacctgagggtgttcccttgggcctgaggaatatccacatatttggtcttgccaatgtgctacatcgtcctattattctgttagattccctcagtggcatgagaagctctggtgattattcagccacctttctacctgggctcatccctgcagagaagtgcactgggaaagatggtcatttgaacaaaccaatctgtattgcatggagcagctccggtagaaaccattatatccccttggtaggcataaaaggggctgctttgcccaaactgcctatgaatttgcttcctaaagcatggggtgtgcctcaggaccttattaaaaagtacataaaacttgaagaggatggtggttgtgttattggaggtgacagaagtttgcaagataaatacttacttaggcttgttgctgctatggaagaagtctttatggacaaacatggtatccatcctagtttggttgctgatgtccatcagtatttctacagaaggactggagtgataggagttcagcctgaggaagtcacagcagctgctaaaaaagcagtaatggataatcgccttcacaaatgtttgctctgtggtgccctttctgaacttcatgttcctccagagtggttggctcctggagggaaattgtataacctggcaaaaagtactcatggacagctgaggactgacaaaaattacagctttcccttgaacaatttggtttgctcatatgattcagtgaaagatgttctggtaccagactatggaatgagtaacctaacagcttgtaattggtgccatggcacatctgtgcgaaaggtcagaggagatgggtctattgtgtatttggatggagacagaactaattctaggtccactggtggcaaatgtggttgtggattcaaacacttttgggatggtaaggagtatgacaatctaccagaagctttccctattactttagaatggggtggaagagtggtcagagaaacagtatattggttccagtatgaaagtgattcatctttgaatagtaatgtttacgatgttgcaatgaaacttgttaccaagcactttccaggtgaatttgggagtgaaatcctagttcagaaagttgtccacactatattgcatcagactgccaaaaagaatcccgatgattatactcctgtaaatatagatggtgctcacgcccaaagagttggagatgttcaaggacaagaatcagagtctcagctcccaactaaaattattcttactggacagaaaacaaaaactttgcacaaggaggagttaaacatgagtaaaactgaaagaactattcaacagaatattacggaacaggcttctgtaatgcagaaacggaaaacagagaagttaaaacaagaacaaaaagggcaacccaggactgtttctcccagtaccattcgtgatggtccatcctctgcacctgctacacctaccaaggctccctattcaccgacaacttctaaggagaagaagatccgaatcacaactaatgatggacgacagtccatggttacccttaagtcttcaacaaccttttttgaacttcaggaaagtatagccagagaattcaacattcctccatatttacagtgtattcgatacgggtttcctcctaaagagttaatgccaccacaggcaggaatggaaaaggaaccagttcctttacagcatggcgacagaattacaatagaaattctaaaaagtaaagctgaaggtggtcagtctgctgcagcacactcagcccacactgtgaaacaagaagatattgctgttactggtaaactgtcatctaaggaacttcaggagcaagctgaaaaagaaatgtactccttgtgtcttttagcaacattaatgggagaagatgtatggtcttatgcaaagggacttcctcacatgtttcagcagggtggtgtattctacagtattatgaagaaaaccatgggtatggctgatggcaagcattgtacttttccacatctgcctggcaaaacctttgtctataatgcttctgaagatagactggaattgtgtgtggatgctgcaggacatttccccattggtcctgatgttgaagatttagttaaagaggctgtaagtcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtactgaaaatttgaatacagaaacaactgatggctgtgtagcagatgcactgggagcagcctttgccacaaggtcaaaagcacaaaggggaaattccgtggaggagcttgaagagatggatagtcaagatgctgagatgactaacacaactgagccaatggatcactcttgatttaattagaggctaataaaggcagaatgtttattgtgaatatgtaatatttgttggctgggccacgtaacttgattagtcattaaaaatcttgtacgtatataaaaaaaaaaaaaaaaaataataataaataaaaaaaaaaaaaaaattaaaacaataaaaaattaatatataattatattattaataatatttaaaattaatataatattatcattctaaatttaatttatatataataaaaattcttgttgcctctttcccccaattcttttatatatccgcgattttatttcgcgggcccaattctgccctttttgggccaaatccccttaaggggggggtattacatttggggccggtgttc

SEQ ID NO: 325623 - DNA, 969 bp, Homo sapiens
cgcattacagatttgcgtctaagagtgacaggattaacagaagatcatgagtatgaattcagggtctctgcagaaaatgctgctggagttggggaaccaagtccagctacagtttattataaagcctgtgatcctgtgttcaaacctggcccacctaccaatgcacacattgtagacaccactaaaaattcaatcacacttgcctggggtaaacccatctatgatggcggcagtgagatcttgggatatgtagtagaaatctgtaaagcagatgaagaagaatggcaaatagttactccacagactggcctgagagtcactcgatttgaaatttcaaaactcactgaacaccaagagtataaaatacgagtctgtgccctcaacaaagttggtttaggtgaggctacatcagttcctggtactgtgaaaccagaagataaacttgaagcacctgaacttgaccttgactccgaattaagaaaaggaattgttgtaagagctggtggatctgccagaattcacattccattcaaaggtcgtccaacgcctgagatcacttggtctcgagaggaaggtgaattcacagataaggtccaaattgaaaagggagtaaactatacccaactatcaatagataactgtgatagaaatgatgctggaaaatacattcttaagttggaaaacagcagtggatcaaagtctgcttttgtaactgtgaaagttcttgacactccaggaccaccacagaatttggcagtcaaagaagtgagaaaagattctgccttcctggtatgggagccacccatcattgatggaggggcaaaggtcaagaactatgtgattgacaaacgtgagtcaaccagaaaagcgtatgctaatgtgagtagtaaatgcagcaaaacaagttttaaagtggaaaaccttacagaaggagccatttattacttcagagtcatggctgaaaatgaa

SEQ ID NO: 325624 - DNA, 775 bp, Homo sapiens
cttgaggtcggtagatggagaccatcctggccaacatggtgaaaccctgtctctactaaaaatacaaaaattagctgggtgtggtggtgtgtacctgtagtcccagctacccaggaagctaaggcaggagaatcgcttgaatccaggaggcggaggttgcagtgagctgagatcgcactactgcactccagcctgggcgacagagcaagaccaccatctccaaaaattatatatataaaaataattaatattatagaagagaatatacacaactcagagatgcaatggataatataaaaagagtacctgagatgtatttttttaaactcttagagatatctgtaactcaaatttttcttaggtgaggaggattattaactggcacatatgtactaaaaacccctcacttaaaaatggcagtctcaatcctactgtcatcctttttattttaaaataaataaataagcctatctttttgtgcttacatacttaaaaggatatcattaagtatataaacaatcattacttctgtatttttaatgaatgcaggaaaataatatttttatgtataaaaaatgaagaaaaaattttgcaagtctttaagcacataaatacaacagaatagccacccaatttctgtctgaaatctaaattggatggatttgaccatcattctattatctttgatttctacaatgtctatatcttattacctataactattaatttttcatagaattataaatgtcatttgactatgtcaatctgtatatat

SEQ ID NO: 325625 - DNA, 766 bp, Homo sapiens
cgtgcgagtgggcgttgggggtgggcaggactggaagttcctctactccgtgcgtttacggggtcctggaggaggctcctgggacctcgagcttgggggaaagccggtcggggagactgactccccccgaccccatccttccaagcgcgactaccgggacgcctggctcctcccggcggccgtcgggaggcgatgccgaagctttagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcagatagtggatgtgggcgtgatgtgtggcacagagtgtagaggggtgaaggtcctgggaagaggcgcaaa

SEQ ID NO: 325626 - DNA, 1053 bp, Homo sapiens
  misc_feature (8)..(8): n is a, c, g, or t
  misc_feature (17)..(17): n is a, c, g, or t
tggctagntacgaggcngggtgtgaatcggccgagggtcggaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325627 - DNA, 1004 bp, Homo sapiens
  misc_feature (8)..(8): n is a, c, g, or t
  misc_feature (17)..(17): n is a, c, g, or t
tggctagntacgaggcngggtgtgaatcggccgaggggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325628 - DNA, 1285 bp, Homo sapiens
  misc_feature (8)..(8): n is a, c, g, or t
  misc_feature (17)..(17): n is a, c, g, or t
tggctagntacgaggcngggtgtgaatcggccgagggtcggaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacaaaaaaaaaaaaaaaaaaaaaaaaaaaaaaaaaaaaaaataaaaaaaaaaaaagaaaaacaaacggcggggacattattgttggggggggggagaaaaaagggtgtattaaaagggcctgatggttaaaatgtgattctccgagaaccgctttttttggaaaaaagggggaaaaaaaagggggggcacccaaaagggagggggaaaaatttgaaaaacgggggaacctgaaaa

SEQ ID NO: 325629 - DNA, 1403 bp, Homo sapiens
  misc_feature (8)..(8): n is a, c, g, or t
  misc_feature (17)..(17): n is a, c, g, or t
tggctagntacgaggcngggtgtgaatcggccgagggtcggaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacaaaaaaaaaaaaaaaaaaaaaaaaaaaaaaaaaaaaaaagcgtgggggggcgcgcccggggcccccgagaaaaacttttcaaaacccaggggggggggcgcggggggcccagagggaagggaaagggggcaaaaggggtcccacagagaaaacccggggacacgcaaacaaggggggggagatcccacacacaaaaaaaaaaggccccggggggaacaccggaggggtttgaggaaacaacccaaagaaggggaggtccgaggagggcaattacaggggaggcttctaaacaacgggggagcccaaaggagaaccgccagaattaaaaattaacccccggaccgggggggc

SEQ ID NO: 325630 - DNA, 1173 bp, Homo sapiens
cgtgcgagtgggcgttgggggtgggcaggactggaagttcctctactccgtgcgtttacggggtcctggaggaggctcctgggacctcgagcttgggggaaagccggtcggggagactgactccccccgaccccatccttccaagcgcgactaccgggacgcctggctcctcccggcggccgtcgggaggcgatgccgaagctttagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325631 - DNA, 1325 bp, Homo sapiens
ggtttcatcctgttgcctaggctggagtgcagtgcctggatcataactctggatcatcactgaaacctgaaactcctgggctcaagcgatcctcccatctcagcctcccaagtagctgggactacaggcctgcaccaccatgcctggctaatttttaattttttttttttagagatgaggcctcactatgttgcccaggctggtatccaggtcctggcatcaagtaatcctctcaccttagcttcccaaagtgctggctgggatcacaggtgtgagccaccatgcctggccttgtctctgttttatagacgaggaaactgtggcacaaagagcttaaataacctgcccaggtcacgcagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325632 - DNA, 1095 bp, Homo sapiens
agaggagcggcgaaggaggcagggcctatttgctgggctgtccgggatgggggtggccgggacctgaaagtaggagaggggtttccgcttccggcaggagtcggaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325633 - DNA, 929 bp, Homo sapiens
  misc_feature (8)..(8): n is a, c, g, or t
  misc_feature (17)..(17): n is a, c, g, or t
tggctagntacgaggcngggtgtgaatcggccgagggtcggaagtcactatctcccgggtgaacggagctttcgcagctggagaaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggactacacagcacctcaaaagcaggggcccatcacaaggggaatcgcgatctctataaccaccttagaagtgcgcgggcagggaataaaaggcggcagccccaggaaccgggggggccagaaagggagcgcgcccta

SEQ ID NO: 325634 - DNA, 1097 bp, Homo sapiens
  misc_feature (8)..(8): n is a, c, g, or t
  misc_feature (17)..(17): n is a, c, g, or t
tggctagntacgaggcngggtgtgaatcggccgagggtcggaagtcactatctcccgggtgaacggagctttcgcagctggagaagacggagtcttgctctgttgcccaggctggagtgcaatggtgcgatctcggctcactgcagtctccgcctcttgggttcaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagcctgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325635 - DNA, 369 bp, Homo sapiens
ttttttttttttagagatgaggcctcactatgttgcccaggctggtatccaggtcctggcatcaagtaatcctctcaccttagcttcccaaagtgctggctgggatcacaggtgtgagccaccatgcctggccttgtctctgttttatagacgaggaaactgtggcacaaagagcttaaataacctgcccaggtcacgcagtaagtgagagagatggggttagagcctcgtctcaccccttccatccagagtgggacagggaattgtcctcctgcatcaggactgagggcctcgtccctcaagggcagaggccccgggaccacggtgcaagtcccagaccctctttccggcctgctttctagagcattg

SEQ ID NO: 325636 - DNA, 1170 bp, Homo sapiens
aggctcttaggctccacccggccctgaacagctggcttgtcttggagtctcttgtgccaccctccccaggaacagtggcttccttgtattggcgccagcgatgatgggccagctctgtgctaaacggagtcttgctctgttgcccaggctggagtgcaatggtgcgatctcggctcactgcagtctccgcctcttgggttcaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325637 - DNA, 1213 bp, Homo sapiens
tgcccaccacactgtcgggaacataggtacggcgcgggttaatcggacgaggcaggatccatccaaacacccagaaccctcccacctgtccctcctctctccctcacctgccaggggacggacagctgccctgagccttcacacagtgttcctctactcagaagtgcctgtccccacttctctgccctgcagtctgtcatctggatcgaggccatcagataacctgagtgtcactcctcctggatggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325638 - DNA, 1525 bp, Homo sapiens
ggtttcatcctgttgcctaggctggagtgcagtgcctggatcataactctggatcatcactgaaacctgaaactcctgggctcaagcgatcctcccatctcagcctcccaagtagctgggactacaggcctgcaccaccatgcctggctaatttttaattttttttttttagagatgaggcctcactatgttgcccaggctggtatccaggtcctggcatcaagtaatcctctcaccttagcttcccaaagtgctggctgggatcacaggtgtgagccaccatgcctggccttgtctctgttttatagacgaggaaactgtggcacaaagagcttaaataacctgcccaggtcacgcagctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtgtatccttggaaacctgggctttttccagagggtggggagggggctggagtccggaccctgctcatctggcccactgtgtgccctggtgcagggccaaagccgtccagaggaacaggtgccacctagtgatttctgtggggtgagaagatgcagggcagggttccaatgccaatgatcgcccttgacctaagtggcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgttgtgtgtgtgtagtgggtgtgcgtgtgtgtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgccctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcaca

SEQ ID NO: 325639 - DNA, 1818 bp, Homo sapiens
cgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacatctgatatgtgctgcaacatgggtgaatcttgaagtcattatgctaagtgaaataaaccagacataaaaggacaaatacatcg

SEQ ID NO: 325640 - DNA, 1522 bp, Homo sapiens
cgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactc

SEQ ID NO: 325641 - DNA, 2154 bp, Homo sapiens
cgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacaagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgtta

SEQ ID NO: 325642 - DNA, 2188 bp, Homo sapiens
cgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacagtaagttggagtttgttggtccagttttgaaaagcacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacaagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgtta

SEQ ID NO: 325643 - DNA, 826 bp, Homo sapiens
cgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataagtaagtatggtaccacttagctgaaagtaaaaatatctaggtaagaaagattttggtaaatgtaattcaagtcattaagactcaaggagtatgaatgtggacaaaagcgttcattttcttaatgagtagtgactcaacattgagttttttttttttaattcgagctaagaatgtaacacaatacaaaagtaataatgacactttcagttttgcttttatgatctaatacttaatacctttacccaaggtgaactgggcagtcact

SEQ ID NO: 325644 - DNA, 2438 bp, Homo sapiens
cgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacaagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaatttttcacccaactgcttggtttcaaagatcttaagtgaaaaactgcctcctggtcaataccaaatttgtacagagtgtgaagtggagtttttatgcttctgtcaaacttccatccatctaatactgtacctgtgtcatattttattcctttgtagtcttctaaggaattggaagtttctgtatgatgcgctttactagttgtaaaatagactatcagagggaaaaggcctctctagtttatttttgaaaaatgctccaggtcttaataattttca

SEQ ID NO: 325645 - DNA, 1085 bp, Homo sapiens
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t
  misc_feature (1005)..(1005): n is a, c, g, or t
  misc_feature (1016)..(1016): n is a, c, g, or t
  misc_feature (1033)..(1033): n is a, c, g, or t
gcatgccctgtgaccaggcagggatgggctatgtcgctgttggggaccacgagggatggccagtgaggaggggtcagaggctgtgaggggaggactgaggctgggtgtggtgtcctgggatggaagnggagancnaancngatnanagacggcgacaagannaacgacggccgcattgacttcgacgagttcctgaagatgatggagggcgtgcagtaaggagtggacagtcgcctctaccaagatcgcgtgtccctagggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaaaaaaaaaaaaaaaaaaaaatttgggcgcgcggcccaaaaattttaaacactcgtggggcgggcccaaggaangacatggccanggccaagaaccggcganagggggtcccaaaaaaccgggcacgtggaacccaaggtcggctggttaagcc

SEQ ID NO: 325646 - DNA, 353 bp, Homo sapiens
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t
gcatgccctgtgaccaggcagggatgggctatgtcgctgttggggaccacgagggatggccagtgaggaggggtcagaggctgtgaggggaggactgaggctgggtgtggtgtcctgggatggaagnggagancnaancngatnanagacggcgacaagannaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 325647 - DNA, 933 bp, Homo sapiens
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t
gcatgccctgtgaccaggcagggatgggctatgtcgctgttggggaccacgagggatggccagtgaggaggggtcagaggctgtgaggggaggactgaggctgggtgtggtgtcctgggatggaagnggagancnaancngatnanagacggcgacaagannaacgacggccgcattgacttcgacgagttcctgaagatgatggagggcgtgcagtaaggagtggacagtcgcctctaccaagatcgcgtgtccctagggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 325648 - DNA, 699 bp, Homo sapiens
gctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 325649 - DNA, 780 bp, Homo sapiens
gggcccttggctccaggagggacttgggaagcctgggtcggcctgagggagtcccaggcctgccgcagagtcatcccagtccggccagtgttcacaggcttgcacaatctgatttgaacctcacacatgggaagtaggcaaacagggaaactgaggaccagagaggacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaaggagtggacagtcgcctctaccaagatcgcgtgtccctagggtgtgggagactccgccctgccgggtccccaccagggaggcgcgaccccttgtgggtctttgtctggaaggaataaaagcaaatgttccaaaa

SEQ ID NO: 325650 - DNA, 708 bp, Homo sapiens
  misc_feature (127)..(127): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (144)..(144): n is a, c, g, or t
  misc_feature (146)..(146): n is a, c, g, or t
  misc_feature (161)..(162): n is a, c, g, or t
gcatgccctgtgaccaggcagggatgggctatgtcgctgttggggaccacgagggatggccagtgaggaggggtcagaggctgtgaggggaggactgaggctgggtgtggtgtcctgggatggaagnggagancnaancngatnanagacggcgacaagannaacgacggccgcattgacttcgacgagttcctgaagatgatggagggcgtgcagtaaggagtggacagtcgcctctaccaagatcgcgtgtccctagggtggtggagtgcaaaggaggcgacctgcaacagaggagtcccggtcaccagcaaccatgacggaccagcaggctgaggccaggtcctacctcagcgaagagatgatcgctgagttcaaggctgccctctagaagtaggctgtgtttccaggtgttcacccgtggtgcccacagtgccgacccgtggctgggtcgagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgcagtggcgtgtagggaacactgccctggctcagcgtgcgagctaaggtggcgatgtatgcgatgggactctgcatgggatagtacagttgtg

SEQ ID NO: 325651 - DNA, 2797 bp, Homo sapiens
cgggccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcaggccggccggagccagagagctgccggcaggaggcggcggcggcaagaacttgaacttggcgtcgggagcgggcgccccggaggccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccctcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcggactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatataaaaatta

SEQ ID NO: 325652 - DNA, 2370 bp, Homo sapiens
cgggccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcaggccggccggagccagagagctgccggcaggaggcggcggcggcaagaacttgaacttggcgtcgggagcgggcgccccggaggccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccctcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcggactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatcca

SEQ ID NO: 325653 - DNA, 2301 bp, Homo sapiens
cgggccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcaggccggccggagccagagagctgccggcaggaggcggcggcggcaagaacttgaacttggcgtcgggagcgggcgccccggaggccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccctcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcggactcggagagcacagtcagcccccgactgcgggagagcaactacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatataaaaatta

SEQ ID NO: 325654 - DNA, 2765 bp, Homo sapiens
cgggccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcaggccggccggagccagagagctgccggcaggaggcggcggcggcaagaacttgaacttggcgtcgggagcgggcgccccggaggccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccctcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcggactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccactccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatataaaaatta

SEQ ID NO: 325655 - DNA, 2754 bp, Homo sapiens
cgggccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcaggccggccggagccagagagctgccggcaggaggcggcggcggcaagaacttgaacttggcgtcgggagcgggcgccccggaggccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccctcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcggactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactgagcggcaccaccgcccgatgaccgcggcagcctgaccgatcccagcccccaatggaagcgcgcat

SEQ ID NO: 325656 - DNA, 2336 bp, Homo sapiens
cgggccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcaggccggccggagccagagagctgccggcaggaggcggcggcggcaagaacttgaacttggcgtcgggagcgggcgccccggaggccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccctcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcggactcggagagcacagtcaaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatataaaaatta

SEQ ID NO: 325657 - DNA, 1243 bp, Homo sapiens
  misc_feature (2)..(2): n is a, c, g, or t
  misc_feature (555)..(555): n is a, c, g, or t
  misc_feature (578)..(578): n is a, c, g, or t
cngggcctctctctgcagctgctgcagttcgagcctacccggcgcctgggcatgggagaaggtggtgtcagcaaactcaagtcccatccctttttcagtaccatccaatggagcaagctggtggggtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagnaatggggggaggaaggaatgcangggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325658 - DNA, 459 bp, Homo sapiens
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccactcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325659 - DNA, 690 bp, Homo sapiens
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtaaaaccccgtctctactacaaatacaaaacatagccaggtgtggtaggcaagtgcctgtaatcccagctacttgggatgctgaggcaggagaattgcttgaacctggga

SEQ ID NO: 325660 - DNA, 2921 bp, Homo sapiens
  misc_feature (2233)..(2233): n is a, c, g, or t
  misc_feature (2256)..(2256): n is a, c, g, or t
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagnaatggggggaggaaggaatgcangggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325661 - DNA, 3260 bp, Homo sapiens
  misc_feature (2572)..(2572): n is a, c, g, or t
  misc_feature (2595)..(2595): n is a, c, g, or t
aagaaaagaaaacagaatcctgagctggttatgattctatcattaccaccacttaggaaggacctggatccatgaaaagaccttacccactttagctctgaccccttcagtctttggaggtgaatatgagtctccctgacattcagtggaggaaactggggtgcggataggggtgttgctaccagctaggtcctccctaatgcatttgcccattccaggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaaccccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagnaatggggggaggaaggaatgcangggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325662 - DNA, 1436 bp, Homo sapiens
  misc_feature (748)..(748): n is a, c, g, or t
  misc_feature (771)..(771): n is a, c, g, or t
tatctccacatgggcccactggggaggaggactcttgattctggtttcagacttgctctaagtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagnaatggggggaggaaggaatgcangggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325663 - DNA, 579 bp, Homo sapiens
ggccggtacgtgagggggaggcctggcccgcggacccggctcccagctcgggcaggtacggtgttttgtccggtcccttctccaccctcccaggcgaggggccccctcggccgtccctccaccctgggaccgtgcaccttgcggctggggccccgtgggttgcacgcgccgctttctgtgtccaggcggggccggcggctctgcccggcaggaccctgcccggcggggtggaccctgaagccagtcctacccgggcaccccccagagcaaggcctcagagcctcaagttcccctgggcttggccgagcagggatggtgcggcctccctctgcctcctggccgcatcctggccgggattcagctccccgccggctgaggctgtgggtctccctccccgccccaccgcccatcctgctctctcctctttctctccaaatgacctggggttggaagttccgggtcctgcccattcccagtgggacctgggagagcaaaggcggggtagctttgtgggcctctctctgagccccttcccttcccgcagccacggctgtcatccctttggccgcctgggtcaca

SEQ ID NO: 325664 - DNA, 2841 bp, Homo sapiens
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaaccccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtgggggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325665 - DNA, 3621 bp, Homo sapiens
  misc_feature (2933)..(2933): n is a, c, g, or t
  misc_feature (2956)..(2956): n is a, c, g, or t
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaaccccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagnaatggggggaggaaggaatgcangggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 325666 - DNA, 3433 bp, Homo sapiens
  misc_feature (2233)..(2233): n is a, c, g, or t
  misc_feature (2256)..(2256): n is a, c, g, or t
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctctcagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagnaatggggggaggaaggaatgcangggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggcctaaaaaaaaaaaaaaaaaaaaaaaaaaaaaaaaaaaaaaaaaaaaaaataaaataaaaaaaaaacacaattaaaaaaaaaataacttataataatgttcaaacaactaatttaatcaaatatttatataaatataatttaatctcatcctttccctctctccccaaaatcctcctaaatcatttgctttctaattaaatttcccttttttcacatcttgctctttgtaaaatcctttttgtaccataactcaatccttttgacctaatacccccttttcccatttctttatctgtaaaaaccctcgcaccttgttttttgttaaaaacttcttgacccaattccctaaatctactctttactcttaataattctatctaaatgtctgttatccttttttttatcactcctttttgaaaacaaatttgccttttattaaaatttccttttaacattcaatattattccccctttgattctcctatatatcccctctgtcaccaaaaccctgtcgt

SEQ ID NO: 325667 - DNA, 1325 bp, Homo sapiens
gcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgattggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaaggcaggtgccaccctgcccctgccactctgcattccccttggatctttctcagggctcttggaaactcctacccagaacctgcatttgaagcctgcactccctcccacaaaagctggttgttctgcctgaacatgccccactttccagatggacacacatgcatgcacacacacacatacacatacacatacacat

SEQ ID NO: 325668 - DNA, 453 bp, Homo sapiens
ggaagaaccacgtgattcaacctcttttgtttgcgctctaggaaattaaggctcataaagtgacataaggagtattccctttttttgtatcctctggaagaattttaataagattggagtgattttcctttcaagcatcagtagaattcaccagtaaaactgtctggagctgggtgcagtggcttacacctataatctcaactacttgagaggctcaagcaggaggatcacttgaggcaaggaattcaagaccagactgagcaacaagactccatctccaaaaaacaaaaaccaaacaaaacagaacagaacagcacagcaaaaccatctcggctgggtattttccttgtgtgaagtttgtaaaatacgactttggtttatttaatagttatgaaactgttcaattattttctttctccttgagtcagtttaataaaataataggttctagaa

SEQ ID NO: 325669 - DNA, 751 bp, Homo sapiens
gtttttgttgctacgtcttccttggttttttacgttgtgttaatgccgctgttttgggtacagtggggagtaggtacatgggtttaggatgctgcatttttgcccatggccttgattgaactccttagtcatttataacgtggttgggccggaaggcctgagaagatacgtaggtacaatcctcttttaaaaagaccacagaattagccaataatacattataaccagtagtctttgaatggcccgtttaaattaaattaaacgaattcatttttaaaataatataatgaacaccttctttaacttgacatgctaaccaagaactaaaatattatcaattaactttcatcagcttgtaagtggtccccatcttgtgccactgcctctccatcagaagtaactcccatcctgaatttgtgtttacacaactattatattgctttaatttcttttcacatttatatatattactaagcaatgtatttttacttttcttagttttgtgtgtatttccaaactctcatctagaggcctgggcctggtacatttttctttactcatctttattgaccgaagttacattttgttcattttcactgctacataaaaatccattatgtaccataatttatccattctccagctgccaagtctttgtgcaatttccagtcttttgctctttccaacagtgttggaaatcagcattgctttctggtgcccctgtgcaaaaatgtctcttgggtgtatttac

SEQ ID NO: 325670 - DNA, 1545 bp, Homo sapiens
agaagggagaccagtaagataggagtatataaatattccattgacattgtaaaaataaacatttcaaactaagagtcagcatatttaattaaatatcagaagtattatttattaaatgaggggaaaaatgatgcctacaccatgagtcaattttttctgaaaccactagtcatcataattaggaatgggaaataatatttgaaaagaggtggccaggcgcagtgactcacatctgtaatcccagcactttgggaggccaaggtaggcagataacctcagtcaggagttcaagaccagcctggccaatatggtgaaaccccgtctctactaaaaattcaaaaattagccagtcttagtgacacgcgcctgtagtcccagctactcgggaggctgcggcaggagaattgttcgaacccaggaagcagaggttgcagtgagctgagatcacaccactgcactccagcctgagcgacagagcaagactgtctcaaaaaaaaaaaaaaagggggtaaaatatatgctttctttcagctaatgtaattgcatatctagaaaaaaacaaatcaactggaaacaatttagagcaagatgatttagtcaggtgactcgttattgtgttaataaataaaagctttcctagacaaataaccacttaaaatataagaaaatatttctgtttacaacagtcatcaaaaatgatcaaatatctaaaaataagtgaaatgtgatacacatatgggaagaaaactttaaaactctcctgagagatattttttaaaaaccactaaaataactggaaagatatattttgttcttgagaaaaactaaattctgtaatttttccaaattataagtaagtatttcatttagaaatcccaactaaaatgccaacaggcttagtctggggaacttgaccaacacaaacatgggagacataaacagtctgagaatgagtaagaagaggaagactaggtgaaacaataactcagtatagagtgaattgtctataacttagagtactagagaaggaagcaccaattcaatggaagagaacagtctcaagagaccgaactacatctgagaatttagtatacaataaaggttggatttcagatcaatagggataatactggcatttcccaataaatgatgttgagataatcagcagctgtttggaaagaaagaaaactgaggctcttcctcactgtttctaccaaaatcaatgtatatgtactttaccagtatatatacagacttctttctagtatgaaatataaactgttaatagtggttacttttaaggagagagactaaggttgggttgggggaagagaaagaaattggtattattttatccttctatactgtgtgctttttttattattttcatgtatttcatttcttcaaaatgtaagaaatgttaaaaatgtatgtgcaaaacaatacaggccactgtactgtgatataatcagatttacattctgacaatgtagatttttttaaatcatgcattaaaacaaatcctgtttcttttaaaaaaaaaaa

SEQ ID NO: 325671 - DNA, 3389 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325672 - DNA, 330 bp, Homo sapiens
ctagttacttaaactcactaagggaaaagagatgataagattagtagcatcagagagatcagtggcagaataagggactgggatatattaatgtgaatggcaactcgtatgtgtgtatgtgtatgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325673 - DNA, 3477 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaaaaaaaaaactttacactaaaaaaaaacctccagggggggcccggtaccccaattgccctattaggagtcgcattacaatttacttgc

SEQ ID NO: 325674 - DNA, 3243 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcactcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325675 - DNA, 3138 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtggctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325676 - DNA, 3174 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtgggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325677 - DNA, 3335 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325678 - DNA, 3177 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325679 - DNA, 1730 bp, Homo sapiens
aggaaaactcgacaggatattgaggggaggctccagccctcgggagtaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325680 - DNA, 1951 bp, Homo sapiens
gccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtgtttgcgtgcaggcgggcccccaaagcttccactcgctgccttaaaacgccaacccagcctctcagacaatgctgccctcccactatggtatctaataaccctctgtgtgtctgtctctgcagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325681 - DNA, 1733 bp, Homo sapiens
ggctaacggtagcgacggccctcgcggtgctgtaacaccttcgcagcacgcagcgactggatgctccacgcagactcataattcgaccgtccatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325682 - DNA, 1477 bp, Homo sapiens
tcgactcagaggatccctcttgccgactgggactggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325683 - DNA, 2261 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgcatgcgggacacaattacagtagggatgctgagcgcagccgctcatggaattcttcttgacgagctgggactcgtgtcgcctcttgtggggcagtatgacatcgctgctcactgcctgtgggacctttcacatgtgtgcgacacgcggccactgatgatgacagtgcgtggaggagaactaagatgtcgtg

SEQ ID NO: 325684 - DNA, 1845 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcaactcccagggactctggggagaggctgaggacaaatacctgctgtcactccagaggacattttttttagcaataaaattgagtgtcaactatttaa

SEQ ID NO: 325685 - DNA, 1424 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcggggccgggtgctgagtgggcggagcgtgacgcctgctcccgggactgtgcagatcgagtggagac

SEQ ID NO: 325686 - DNA, 736 bp, Homo sapiens
  misc_feature (1)..(1): n is a, c, g, or t
  misc_feature (18)..(19): n is a, c, g, or t
  misc_feature (27)..(27): n is a, c, g, or t
naacatgctggtaccccnncgagtatntggatatcgtcgaccaggcgtcgaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325687 - DNA, 619 bp, Homo sapiens
  misc_feature (30)..(30): n is a, c, g, or t
gcggccgctccaacatcagaatggtaacanggcacgagggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325688 - DNA, 2082 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatggtcctggggtggcagaacggggcaatggggaggtgggtaacaccttggcccgcctggaagtaacatccggcggccgggggtcagcaaccaggccggaaggcctcaaatatttccttaccgaaaaaccacgtcggggggatcgaacgctggcgcttggacctagaccgcacggcgtaaaacgtgtgagcaaattgtcgccacacgcctagcaacgccaatagggacgcacctagcggatcaacaccactacaaataaatagaacggggggggataacaacaca

SEQ ID NO: 325689 - DNA, 966 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325690 - DNA, 371 bp, Homo sapiens
ccagcagatgaaatgagatcacattgaaaggatgtggaagggcaggctttgagcattgttagcttggcatggggttgggaggccctggtaacgatggacactgactcttcccaaccccacctacatactctaccacctatgaagagaggaatatcaccggaaccagggtgaaggtgagagcagtgggaggcagcgggggctctacctctttgcctattgctataattttttggttttatttctgccttagtctttgctgtggaatttgattgacactctgcagtccttccccaatttctgtcttttctgccttctggataggtctctactttgtcccttttcccaccccaggtgcccaggctcttcctttc

SEQ ID NO: 325691 - DNA, 416 bp, Homo sapiens
taaatgtgtttacctctctgagcctcggttttccacctctggaaaatgggggtattgatcatcctgccccatggggttgccagcagatgaaatgagatcacattgaaaggatgtggaagggcaggctttgagcattgttagcttggcatggggttgggaggccctggtaacgatggacactgactcttcccaaccccacctacatactctaccacctatgaagagaggaatatcaccggaaccagggtgaaggtgagagcagtgggaggcagcgggggctctacctctttgcctattgctataattttttggttttatttctgccttagtctttgctgtggaatttgattgacactctgcagtccttccccaatttctgtcttttctgccttctggataggtctctactttgtccc

SEQ ID NO: 325692 - DNA, 828 bp, Homo sapiens
  misc_feature (788)..(788): n is a, c, g, or t
  misc_feature (797)..(798): n is a, c, g, or t
gccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtgtttgcgtgcaggcgggcccccaaagcttccactcgctgccttaaaacgccaacccagcctctcagacaatgctgccctcccactatggtatctaataaccctctgtgtgtctgtctctgcagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttcgcagctgcgtgatgatgaagggggnggaacatgnngggcaggccttcacggatcactgcattggg

SEQ ID NO: 325693 - DNA, 3778 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaaaaacacagctcaaacaacgaaaagaagaggaaacaagacacaagcacaaaaagaacaaaagcaaatgggaacaaacaagacaacaccgacggcgcggccgcgaaacaacgaacaacaacacaggacggagacagacaaataagcgaaccacccagccgataaggacaagcagagcgctacctagagcggaaaaacttcacaccccaacgcgcagcgcggcgacaacacacgtgcgggggacgagaacgaagcaccacccgaactagagagagaacgccaaaacagtgagggcacacatagggcaccaccccacagcaagaaggccgagacaaaacagcaggcagttgggaaccacagtacgcggcgggaggcagagagcatgaaatcg

SEQ ID NO: 325694 - DNA, 3378 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcactgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325695 - DNA, 3297 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325696 - DNA, 3286 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgttacaacaccatgctggttattttggcggctgtagttgtggggggatgtgtgtgtgcactgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325697 - DNA, 3268 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacaatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325698 - DNA, 1811 bp, Homo sapiens
gccagcattcctcaccccgaacccacaatgcctcagggctagcacgccagcctcttggggctgaaggaggctgactccccaagtcctgcaaaggggtgcaagcctagttccaaccctgccgggctgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325699 - DNA, 1873 bp, Homo sapiens
gccagcattcctcaccccgaacccacaatgcctcagggctagcacgccagcctcttggggctgaaggaggctgactccccaagtcctgcaaaggggtgcaagcctagttccaaccctgccgggctgaggcatgagtaggggctgtgtttgcgtgcaggcgggcccccaaagcttccactcgctgccttaaaacgccaacccagcctctcagacaatgctgccctcccactatgtactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325700 - DNA, 2291 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccggcagctgcgtgatgatgaatgcgtggggcgcacagggggggccagcatagcgtatcggccatgcgcaggcaatgaggcggcccagggg

SEQ ID NO: 325701 - DNA, 2075 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 325702 - DNA, 1712 bp, Homo sapiens
ggctccctaaataaatacatcaattttatttaaatcttacagcaatcatatgagacaaaagcttttaacacctgcactttatattcgaggaattaaagttctcagaggcgactaaagaccaaactcagggctgaggagttccaaagctgagttgagttgcaaatgaatcaccgaggaccaccggagctttctagcgaccctcgcaccagggaacgaacccctgtggtttaagggctccaacccacaacccagttcctttggcgggaaacagcaccctcccaaggccccgccccttcctggccccgccccgtcgtctctgggcccggctcctggagatgggtattattaatctgccttctatgggggacctggcccatctcgggtatcagccccgcccctactcgtccagtctccgaacgctctgcagccaatcggcgcccgagggtcggtccccgccttctcaagccccgccccctacccttatccctggcagcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgctcgcgcatcaagctcgtggaccgggcaggcaaaatgccccagagggtgtcattcgtccggtctggaaaaattcctcacggtagagttgttactccttta

SEQ ID NO: 325703 - DNA, 4130 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325704 - DNA, 609 bp, Homo sapiens
agtgcagccgaggcggggtgggcacaggtaggaggaggcagacaggatagatcccccgggcaagtcagagttcccattttacactaaagtccagagattttaggtgacctgcttaaggtgccacagcaagtgcaagatagttttttttctcttttactgaacatccacatgtaagctgggttggttacaaatgcttcctaggtaggtcttggcatagaggatgatccgcagaatcgtggggctgctgagaggttcccttggggccttaccccttctgacctagagtgtatgtcaacagattagggcagccgaggaatctgcctcacagattcaatccagtgcccagcgcttggagacccaggtgagcgccagccgctcccagatggaggaagatgtcagacgcacacggctcctaatccagcaggtccgggacttcctaacaggtgagcccagtctccaccccaccttggctgctgttccagtcctgcctgtcccgcattcccatgttcagtgcatcagccagccctccctccctagtcccaggcctgcaacatccagcctccacttctccttggcaccatggccatgaccttctcgttctcccgtctg

SEQ ID NO: 325705 - DNA, 448 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcacaaaaacttaacaaaagtgatgtaaaaatgaaaagccaaataaaaatctttggaaaaga

SEQ ID NO: 325706 - DNA, 4016 bp, Homo sapiens
gggcgggaggaggactgtatctctggatgcctggggcctggtttcagggcctgatttattcctcttcctgggagctcactcaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325707 - DNA, 4039 bp, Homo sapiens
gggcgggaggaggactgtatctctggatgcctggggcctggtttcagggcctgatttattcctcttcctgggagctcactcaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgaggaaaa

SEQ ID NO: 325708 - DNA, 1632 bp, Homo sapiens
tgatacaactcgagctcggtaccgcttcagcccgtgccccactcatctgccgctttgcttttggttgggggcagaagggttggaatgctttccatctccaggagactttcatgcagcctaaagtacagcctggaccacccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325709 - DNA, 3814 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaggcactaggagatgggaaatagtgtggatagagaattacaaggatatcaaaggatgttgacctatttcaaaacttaggttgggccaatccattacctaagaaagggaaaggaaactcaggacttaaataagtactcttagtattaaaaatcagtgacaccaggagttaaataatttctgatatgatccgaattattagtaaccattctggctctttcttctaaggaaaatgtcctgtaggagtcaaaaaagtgactttcacctaaacttcccgaattcggcatactcctcataacttaaggatggcttgtccaatataattcacgtaaaccgtgat

SEQ ID NO: 325710 - DNA, 3063 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatagcagcctacggggcaatgccccctaggctagtaagtttattcaatgcaaaagaatacctctccaattataactgaggtggctgaccacgtacacgaacaaatccgactctaaa

SEQ ID NO: 325711 - DNA, 2676 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaaggtgacttggggcatggagtcccacttcctggagcccacaccccagcttgtcacacaccaactgctgccacctgcgatcctatta

SEQ ID NO: 325712 - DNA, 1164 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtaggtagagggaatcctgaaaagtaggcctggggagaaatccctgatgtcccactgttcacacagccacacggactcctgagaagggacggaaacaccctcgccagctccccttgctgactttcctgaattcccaccagtaatgacccctgtggccaccctcaaaacatttgctgcttatcctctttgctgaggaaggatatttcagcaacaccttggggccaccgcattactcacccctgccgtcttccacagccccctcccccgtgactcattggctcatccctctagtgggaagatgaaatcgaccctactttgatatgaggactttgggatgctagttagatgcaagtgagcaaattacac

SEQ ID NO: 325713 - DNA, 4204 bp, Homo sapiens
  misc_feature (4049)..(4049): n is a, c, g, or t
  misc_feature (4054)..(4055): n is a, c, g, or t
  misc_feature (4061)..(4061): n is a, c, g, or t
  misc_feature (4063)..(4063): n is a, c, g, or t
  misc_feature (4070)..(4070): n is a, c, g, or t
  misc_feature (4075)..(4075): n is a, c, g, or t
gggcgggaggaggactgtatctctggatgcctggggcctggtttcagggcctgatttattcctcttcctgggagctcactcaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagaaaaaaacaaaacacaaaaaaaacaacaacaaanaaaannacaaananaaaaaanaaacnacaaaaaaaaacacacaaacaaccaaacacacaaccaaccacacacaacacaagagcgggcgggcgggcgccgccaactcaacaatccccccgcagagggggcgccaccactacatcgcacccccccca

SEQ ID NO: 325714 - DNA, 3978 bp, Homo sapiens
taggggtttgcactgttgtacccagtttgctttgctgtgtcctaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325715 - DNA, 1338 bp, Homo sapiens
tgaaagggggcagcagctccttgggacaccacggtagaggggccactgtgggtgccttccacaagtgctgctcagctaggagaggcctcgtatctctggggaggttagtgggctcctacagtcaaatgcgtgttgtcttccagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325716 - DNA, 3114 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgcaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325717 - DNA, 1104 bp, Homo sapiens
gtgggggtgcagtgacgacagatgggtgtgacggctgccagattcctgagacccgccctgcggtggggctacacccagccagggagtctccagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcccagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgcattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaaga

SEQ ID NO: 325718 - DNA, 453 bp, Homo sapiens
gccccagtgcctcccctctgcacactgcccctgtctccacaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtaggtagagggaatcctgaaaagtaggcctggggagaaatccctgatgtcccactgttcacacagccacacggactcctgagaagggacggaaacaccctcgccagctccccttgctgactttcctgaattcccaccagtaatgacccctgtggccaccctcaaaacatttgctgcttatcctctttgctgaggaaggatatttcagcaacaccttgg

SEQ ID NO: 325719 - DNA, 341 bp, Homo sapiens
tatactttctcaggatttggttattttggaaggacttctttttatctgatagtacaattttgctgatggtattattcccatttgacagcttttttattattattataaatttaacaatatcagtttccttttgacatgcaaaaatgttttaaataaattcactggttatctcatgagactatgcttataaacggaacatcatttttatcttcagcacccaaaattctattcttatatgtgatttttgaaattttgcttatttgggtgttataaatatatttgtgtgtatctaagtttgttttttcagctttttcatgtttacgtattttcttgtaataaat

SEQ ID NO: 325720 - DNA, 406 bp, Homo sapiens
tgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtcagctgtactttagtctagaggatggatcaacatatacccaatgacctacaagaatgttttggatcaagtggagatacaaaggagaaggcagccatgtcctgaccattgtctttctttcccatcctggctggagagagcacagtggggaagagaaataagagagaagacaacccaaaccttaactctcatgcagtactgggcggtggtgagctcaaaggctttgccatcagacccctgggttcatatcccagctccaccacttgcaaa

SEQ ID NO: 325721 - DNA, 352 bp, Homo sapiens
gtgaactcagacatgatcgtgggagttgcttcggccatgaaatgtgtaccgagatggtgtgtttcccttcccagcagcagctttaagagcttgtgcatggtttggcattctctcttttccttctgccaccgagactgcagtattccagatatgagccaatcctctcacttaaatcctgaaatgtggacaacatggaatcaagtcagagccaactggttccggacacgggtatgaaagagaaataaatcttttctgttgtaagccacagagattgtgggattgttgccacagtatgacctggttaaccttgacaggtacagggctccacacacactgttttctttcttctcct

SEQ ID NO: 325722 - DNA, 325 bp, Homo sapiens
caggtgactgagatgtacatccaaagaaggggataggaggccaaatgagctgataccctcctgcaggtgtgaaccacttgtgtgaggacagaggaaaagatgtatgtttgtcagccgggtgtggtggctcacacctgtaatcctagcactttgggaggctgaggtgggcagatcacctgaggtcaggagttcaagactagcctggccaacataacgaaaccccgtctctaccaaaagtacaaaaattagccaggcgtggtggcgtgtgcctgtaatcccagctactcaggaggctgaggcaggagaattgcttgaacccaggagg

SEQ ID NO: 325723 - DNA, 296 bp, Homo sapiens
aatctaatcaacaaaataactaattggaaaatgaattataagccgggtgcttataatttgcacctctctttgggagaccgaggcgcatagatcacaaggtcaggagatgaaggccatcctggccaacacggtgaaaccccatctctactaaaaatacaaaaattagctgggcgtggtgagctcgcacctgtaatcaagctattcaggaggctgaggcaggagaatcacttgaacccgggaggcggaggttgcagtgagccaagatctcgccactgcactccagcctgagtgagaga

SEQ ID NO: 325724 - DNA, 560 bp, Homo sapiens
cattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaa

SEQ ID NO: 325725 - DNA, 524 bp, Homo sapiens
gaggcccaacatccaggccgtattgctgcctaagaagacggagagccgccataaggccaagggcaagtgaaatgcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaa

SEQ ID NO: 325726 - DNA, 1030 bp, Homo sapiens
cattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaaaaaaaaaaaaaaaaaaaaaaaaagaaaaaccccgagaagagtttctcccctttgggggggagggggcgcccaaagaggggggcagagcgggggcgttaggggggaaaaaaaattcccccgggggaaggggggcgcctaactccaagcacaccggggataggggttcccccagtcccttacaggcgacacaggcagaggggcggttccccttcaccaaagagagaccccggggaaaagaagaggagcgcgcgccaaaaggggcaccaacagaggcggcggcgggaagaatcaaaggaaaagccccgcggggaggaagtcagagggacaatggcgcgtccctggggattaggccagagatcaaccggtgaaagcgccgacaagccgggcgagggaaagcgcccctgaacgaggcggaggcaacgggcaaatgagcgatccccgggacgagtataggccaaaactcgggaggg

SEQ ID NO: 325727 - DNA, 371 bp, Homo sapiens
gagctcggtaccccgtgtttatcgatgccacctgacactaatcaaaagaaaactgaagtgtctgtattagtattagacaaagtaagtatcatagtccattgtgtggtactataacaaaatacctgagactgggtaatttatagaaaacagaaatgtatttcttcacagttctggaaactgagaagtccaaaatcaagacaccagcatctgttgagggacttcttgtggcatcctcacatggttgggggtagaaatggcaaaagggggacaaatgctgtcttcttacgtagaaaaaagagaacacactgccacaagctcttttataacagtattaatacagttatgaggggagagccctcatcacctaaaca

SEQ ID NO: 325728 - DNA, 489 bp, Homo sapiens
gtgtgcgcggtcgatctagaggaccccattccattaacaaaagagattgtgaaattagatgaaagattagatgctgtctaccaaaaatccactttaaatataaatacacaagtaggttaatattaacaggatgggaaaagatataccacctgacactaatcaaaagaaaactgaagtgtctgtattagtattagacaaagtaagtatcatagtccattgtgtggtactataacaaaatacctgagactgggtaatttatagaaaacagaaatgtatttcttcacagttctggaaactgagaagtccaaaatcaagacaccagcatctgttgagggacttcttgtggcatcctcacatggttgggggtagaaatggcaaaagggggacaaatgctgtcttcttacgtagaaaaaagagaacacactgccacaagctcttttataacagtattaatacagttatgaggggagagccctcatcacctaaaca

SEQ ID NO: 325729 - DNA, 4612 bp, Homo sapiens
  misc_feature (626)..(626): n is a, c, g, or t
cgcaggtggcaggcaggtggggctggtacagcccgcgccgcctctgctgcagccgctgccgtctactccttgcgcgctggcactccgcagcctttaaggttcgcgcgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactt

SEQ ID NO: 325730 - DNA, 419 bp, Homo sapiens
gaaattctgcatctggtaggtccaaggtagtttgttgttagaagtagcaggatcgccttaataataataatagttttgtagcatgaagcctgagcattgtccaaagtttggaaatgtgaacgctgatagtcacatctgtccatctttccacatttctaggatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttct

SEQ ID NO: 325731 - DNA, 530 bp, Homo sapiens
gaaattctgcatctggtaggtccaaggtagtttgttgttagaagtagcaggatcgccttaataataataatagttttgtagcatgaagcctgagcattgtccaaagtttggaaatgtgaacgctgatagtcacatctgtccatctttccacatttctaggatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttctattggtaggtttttttttaaaattagatgaatatgttagtctttttcaatatcagtttgaatcttattttctgtatgtgttaattttacaaataggcaaacaacataactt

SEQ ID NO: 325732 - DNA, 444 bp, Homo sapiens
ggcctgggtgaaaagtagagagtaggggtaaagctggacatgcaaaggattggtttaaggaatactgtctaagggttagctgtcaatggttggagaagaaggagatcctccttcctctcacccatacattttttcttctttcctctttatcaatgatcacagaccattgagtctctgcaaatccagttcatctagctgaattatctcataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaattagttctgtggctgtgaatgttataattcaggagatttgtagggagattagta

SEQ ID NO: 325733 - DNA, 7056 bp, Homo sapiens
  misc_feature (829)..(829): n is a, c, g, or t
tgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacaggctttcagcttttctctagtgagaggaacctaagcatttgcaaaccctgaagagaaagtaatcaggtaccttgagcaattctgatcatcatcctgtgtcatttttgtacctctcacctgaatctgaaagctacattttttaaaaattttgctttaagttctgagatacatgtgctgaatgtgccagtttgtacataggtatacatgtgccgtggtggtttgctgcacttatcatgaaagttatattaaagcttgttttccttttcaatccatctgaattaatatgttcatatatgggtcatgtctgttgacacttttccatctggagcaactgttccagccttcttccctgtgcctcatataacctaagtgtgagtagagtgaaaaaaaatgtacactgctatgactgtactagccatctcacacagaatcagagaaaaatgatttctgaaatatatagatatttaaaataaaaagaattattgaatattaatatgggaattgttctctgctcagtgctctaggaaatattgaagtgaatacaaggagttaatattctactaggaacagaaagacacactgctcctaattactgtgtttccgtcatttattgaatacacttactaaatatacgctgtaaataggactttttttttttaatactaaggcacatgtaatctctgttttcaagaagcctacagtatagttgcaaatgtaagactcactcagttgtttgttcacagatatctgctgaacatctacaacatgccaactactgttctaagtgctgggaatattgtagtgtacgaagtctctgcccttatggaactcctagcttagtgagagatgaacaataagcaaaggaatatttagtatcatagcagatgctgtgaagaaaaacaaaacagaattaagggatgaagagggagtgggtggaagtctgtgggagaagcctcacaggctgagggaagggcaggtgcccagcccctgatgagggagcaggttagacatgttcatggggcagcagcagacaagtgtgacaggagcgatgtgcccatcgtggagggagcagaagaagctgctaaagtaacaaagggctagattaagaaggaccttgtatgataaggactattgatatgtacccaccagtgactaccagatggcggaaggcaggacgtgtgcaccccaatcagtggtgcacgtgatcagatcgctgctaagtggagccagaggtgcaagagaggttcttttagtgtgctaataacaaggcttgtcaggaagatggatcttaattaaaggatgcggttgatttagtatgtctgagttaggatatagtggaggcagtgggtgaggatgctgaagtgaaggctggaaatgaaagtggtatgatcaggtgagctgtgagaagatgtcagattccacttgaagaacagtcctttggtagaaggaatgaggctgtaaacatagttagggccaaattgtggatatagaatatcttttaaatgggagttgttcctctagttctagatccaaactcatttgaatgatagtttaaaaacttgatcaagcaaaggtaaacaaataatacaaaacatgagaaaatcatctcgaagaattaaagcagtagttttttttttaacctaattaggaagaaataaatagctttctacattagttattgtggagatttaaagatcattttggtttttttgaaaggggggttattctcttgtttaataattatgttgtttttgttaaagcaaatctctaagctggaataaagtttcaaagcagtaagttacaaaaacagaacatacacccaaccaagttatttaaagacctttttatattgctcaggtcagagggactgtctgtctcttccttaccatacctcttgatattttattttggtggtgctcagagaagtaaataatttctgtattgtctttacaaattaatgtgacttccccttcctcttcctttttttttttttttaagttgagttcttttagtagttggcaatgcagtgctttatagcccaacttttgttatgcatttattacaaattctttttaaaattttgtgactttagttaaaataaatccttaataatattttaaaatttgttattatttagtatttttaaataagttatacttgatttatttaaaacatagtcttaaaggtcctttccattttggagttttaaatagaaacactgccaccttgtgttatgtgcagctaatgttggataaactgaaaatcactaactgggtgtattgccaattgaggaaaatatacttttctgtattcttacacttgctgacccgtgttttcttatgttttaccaaagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttct

SEQ ID NO: 325734 - DNA, 7929 bp, Homo sapiens
  misc_feature (829)..(829): n is a, c, g, or t
tgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacaggctttcagcttttctctagtgagaggaacctaagcatttgcaaaccctgaagagaaagtaatcaggtaccttgagcaattctgatcatcatcctgtgtcatttttgtacctctcacctgaatctgaaagctacattttttaaaaattttgctttaagttctgagatacatgtgctgaatgtgccagtttgtacataggtatacatgtgccgtggtggtttgctgcacttatcatgaaagttatattaaagcttgttttccttttcaatccatctgaattaatatgttcatatatgggtcatgtctgttgacacttttccatctggagcaactgttccagccttcttccctgtgcctcatataacctaagtgtgagtagagtgaaaaaaaatgtacactgctatgactgtactagccatctcacacagaatcagagaaaaatgatttctgaaatatatagatatttaaaataaaaagaattattgaatattaatatgggaattgttctctgctcagtgctctaggaaatattgaagtgaatacaaggagttaatattctactaggaacagaaagacacactgctcctaattactgtgtttccgtcatttattgaatacacttactaaatatacgctgtaaataggactttttttttttaatactaaggcacatgtaatctctgttttcaagaagcctacagtatagttgcaaatgtaagactcactcagttgtttgttcacagatatctgctgaacatctacaacatgccaactactgttctaagtgctgggaatattgtagtgtacgaagtctctgcccttatggaactcctagcttagtgagagatgaacaataagcaaaggaatatttagtatcatagcagatgctgtgaagaaaaacaaaacagaattaagggatgaagagggagtgggtggaagtctgtgggagaagcctcacaggctgagggaagggcaggtgcccagcccctgatgagggagcaggttagacatgttcatggggcagcagcagacaagtgtgacaggagcgatgtgcccatcgtggagggagcagaagaagctgctaaagtaacaaagggctagattaagaaggaccttgtatgataaggactattgatatgtacccaccagtgactaccagatggcggaaggcaggacgtgtgcaccccaatcagtggtgcacgtgatcagatcgctgctaagtggagccagaggtgcaagagaggttcttttagtgtgctaataacaaggcttgtcaggaagatggatcttaattaaaggatgcggttgatttagtatgtctgagttaggatatagtggaggcagtgggtgaggatgctgaagtgaaggctggaaatgaaagtggtatgatcaggtgagctgtgagaagatgtcagattccacttgaagaacagtcctttggtagaaggaatgaggctgtaaacatagttagggccaaattgtggatatagaatatcttttaaatgggagttgttcctctagttctagatccaaactcatttgaatgatagtttaaaaacttgatcaagcaaaggtaaacaaataatacaaaacatgagaaaatcatctcgaagaattaaagcagtagttttttttttaacctaattaggaagaaataaatagctttctacattagttattgtggagatttaaagatcattttggtttttttgaaaggggggttattctcttgtttaataattatgttgtttttgttaaagcaaatctctaagctggaataaagtttcaaagcagtaagttacaaaaacagaacatacacccaaccaagttatttaaagacctttttatattgctcaggtcagagggactgtctgtctcttccttaccatacctcttgatattttattttggtggtgctcagagaagtaaataatttctgtattgtctttacaaattaatgtgacttccccttcctcttcctttttttttttttttaagttgagttcttttagtagttggcaatgcagtgctttatagcccaacttttgttatgcatttattacaaattctttttaaaattttgtgactttagttaaaataaatccttaataatattttaaaatttgttattatttagtatttttaaataagttatacttgatttatttaaaacatagtcttaaaggtcctttccattttggagttttaaatagaaacactgccaccttgtgttatgtgcagctaatgttggataaactgaaaatcactaactgggtgtattgccaattgaggaaaatatacttttctgtattcttacacttgctgacccgtgttttcttatgttttaccaaagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgtaagtataaaagtatggattatcattacagttcacctagttcaagtaaagaagaatgtttattcttacttgtttaactatacaggaataactgtacaagatattcctgctgctaaacttcatcagcacatggaactaggaagacgttaagatgactattgtaacttctaacatattctgataattactgaagctctgattctccttagctacctgtattttaaaattgtatattgtatgaattaccaaatttgccttgttgattagtagacatagacatttgtcttgtgatatttagggttcatttttttatggaaagaacataaacatagttttctaatttggagaaatcggtcttaatgcaagtaggcattttaaaattacatttatgaattatttttagaccctacataatcttttttattctgcaatgttaaacagtttctctagaaaatctgtttttgtttcctagtgactattaaactattctctcctacaacagtaatatttatgctataaatttaaatcatcatttttgttttgattgattataagatatatgttttattatcatgtagcctagtttaagagtcctcaatatttctgaagttttagtgattctgctgagagagagcatagaaaaaaataagaaaaaaaaaaaccaacctagtatctgttgttcagtagattgtaggtacttctgtttatagaaataataaggggaaaatgggtattttagaatgaggatacttttgtgttgtacctcttgcttctcttttatttgaataataaaggaaataacatcaaattaatgtttagcctactttagtatggatattgaagttaaaatgtcattcatttgcatttatttaggaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttct

SEQ ID NO: 325735 - DNA, 2799 bp, Homo sapiens
aaggtcgaactccggaagaagagagaaaacggaaaaacaagaaaagcagcacgggagaagcatcggaaaacggactagaagatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttct

SEQ ID NO: 325736 - DNA, 5546 bp, Homo sapiens
  misc_feature (829)..(829): n is a, c, g, or t
tgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacaggctttcagcttttctctagtgagaggaacctaagcatttgcaaaccctgaagagaaagtaatcaggtaccttgagcaattctgatcatcatcctgtgtcatttttgtacctctcacctgaatctgaaagctacattttttaaaaattttgctttaagttctgagatacatgtgctgaatgtgccagtttgtacataggtatacatgtgccgtggtggtttgctgcacttatcatgaaagttatattaaagcttgttttccttttcaatccatctgaattaatatgttcatatatgggtcatgtctgttgacacttttccatctggagcaactgttccagccttcttccctgtgcctcatataacctaagtgtgagtagagtgaaaaaaaatgtacactgctatgactgtactagccatctcacacagaatcagagaaaaatgatttctgaaatatatagatatttaaaataaaaagaattattgaatattaatatgggaattgttctctgctcagtgctctaggaaatattgaagtgaatacaaggagttaatattctactaggaacagaaagacacactgctcctaattactgtgtttccgtcatttattgaatacacttactaaatatacgctgtaaataggactttttttttttaatactaaggcacatgtaatctctgttttcaagaagcctacagtatagttgcaaatgtaagactcactcagttgtttgttcacagatatctgctgaacatctacaacatgccaactactgttctaagtgctgggaatattgtagtgtacgaagtctctgcccttatggaactcctagcttagtgagagatgaacaataagcaaaggaatatttagtatcatagcagatgctgtgaagaaaaacaaaacagaattaagggatgaagagggagtgggtggaagtctgtgggagaagcctcacaggctgagggaagggcaggtgcccagcccctgatgagggagcaggttagacatgttcatggggcagcagcagacaagtgtgacaggagcgatgtgcccatcgtggagggagcagaagaagctgctaaagtaacaaagggctagattaagaaggaccttgtatgataaggactattgatatgtacccaccagtgactaccagatggcggaaggcaggacgtgtgcaccccaatcagtggtgcacgtgatcagatcgctgctaagtggagccagaggtgcaagagaggttcttttagtgtgctaataacaaggcttgtcaggaagatggatcttaattaaaggatgcggttgatttagtatgtctgagttaggatatagtggaggcagtgggtgaggatgctgaagtgaaggctggaaatgaaagtggtatgatcaggtgagctgtgagaagatgtcagattccacttgaagaacagtcctttggtagaaggaatgaggctgtaaacatagttagggccaaattgtggatatagaatatcttttaaatgggagttgttcctctagttctagatccaaactcatttgaatgatagtttaaaaacttgatcaagcaaaggtaaacaaataatacaaaacatgagaaaatcatctcgaagaattaaagcagtagttttttttttaacctaattaggaagaaataaatagctttctacattagttattgtggagatttaaagatcattttggtttttttgaaaggggggttattctcttgtttaataattatgttgtttttgttaaagcaaatctctaagctggaataaagtttcaaagcagtaagttacaaaaacagaacatacacccaaccaagttatttaaagacctttttatattgctcaggtcagagggactgtctgtctcttccttaccatacctcttgatattttattttggtggtgctcagagaagtaaataatttctgtattgtctttacaaattaatgtgacttccccttcctcttcctttttttttttttttaagttgagttcttttagtagttggcaatgcagtgctttatagcccaacttttgttatgcatttattacaaattctttttaaaattttgtgactttagttaaaataaatccttaataatattttaaaatttgttattatttagtatttttaaataagttatacttgatttatttaaaacatagtcttaaaggtcctttccattttggagttttaaatagaaacactgccaccttgtgttatgtgcagctaatgttggataaactgaaaatcactaactgggtgtattgccaattgaggaaaatatacttttctgtattcttacacttgctgacccgtgttttcttatgttttaccaaagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgtaagtataaaagtatggattatcattacagttcacctagttcaagtaaagaagaatgtttattcttacttgtttaactatacaggaataactgtacaagatattcctgctgctaaacttcatcagcacatggaactaggaagacgttaagatgactattgtaacttctaacatattctgataattactgaagctctgattctccttagctacctgtattttaaaattgtatattgtatgaattaccaaatttgccttgttgattagtagacatagacatttgtcttgtgatatttagggttcatttttttatggaaagaacataaacatagttttctaatttggagaaatcggtcttaatgcaagtaggcattttaaaattacatttatgaattatttttagaccctacataatcttttttattctgcaatgttaaacagtttctctagaaaatctgtttttgtttcctagtgactattaaactattctctcctacaacagtaatatttatgctataaatttaaatcatcatttttgttttgattgattataagatatatgttttattatcatgtagcctagtttaagagtcctcaatatttctgaagttttagtgattctgctgagagagagcatagaaaaaaataagaaaaaaaaaaaccaacctagtatctgttgttcagtagattgtaggtacttctgtttatagaaataataaggggaaaatgggtattttagaatgaggatacttttgtgttgtacctcttgcttctcttttatttgaataataaaggaaataacatcaaattaatgtttagcctactttagtatggatattgaagttaaaatgtcattcatttgcatttatttaggaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagaagagaaaactaaggtccccagtcaaaaaggatggtgggaaagaatgtttagatttcaaaatttaaaagccccgagctaggaagaacctgaaaactgagtactcctcaagtgaaaggcaatctctacagaacatcattccttcatatgtttcttagttttctttttccgacgaagaggtctcgctatgtctctcaggctggagagacaggtattcacatggga

SEQ ID NO: 325737 - DNA, 1651 bp, Homo sapiens
  misc_feature (829)..(829): n is a, c, g, or t
tgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaatttaggggtccttgataatccggaaaagcgagaaaaaaaccttagtccccttttggcggttaagaaaaccccccttgaaaaacccttgggggctttggggggcttgaaaaatttttaaaattttttgggaggggatcttttgagaccaggggacttttttcaaaaccccaaaaagaatatgcttttttaaacagggggagttttttttggggacatccaagggtgtcctcccaggttttccccccctttatagaaaagaatttttttaaaaaccctggggattttttttccccccaggttttttcctcgaagtttttt

SEQ ID NO: 325738 - DNA, 604 bp, Homo sapiens
ggtattttataaactctggaagaagtggttatgttgatatttcatagtcaatgaggtagggtttctgcttcctacagtggtaaagtaaaatgagttattgacatgaatgtggccacttccttccttttgaggtaaagcagtagcaaacagtagtctttgaaagttgtttcagttcatttagggctcacttttttttttcttttgagcaataaagttttttcttaaaacacttggctgcttttattaaaatgcttagtgaagtactttattcccagctgatctctctaagtgttgctagtgttgtttctttttgtgggtttgagtagaataatgctctggagaaacaagaatgtcaaaaatgtagttttaatgactgcatgatttagagctaaaatagatacagaatttaacaaaatgaggcagcattcaccctaaaatattttatgcttctgatttcagagtgatcatttaggatcaggaagtcatttcagtaaccgtaagtataaaagtatggattatcattacagttcacctagttcaagtaaagaagaatgtttattcttacttgtttaactatacaggaataactgtacaagatattcct

SEQ ID NO: 325739 - DNA, 458 bp, Homo sapiens
agatatgaactaaagcaataatttgatgttgcttagggaaagtagcattactgtcattagccacacattctttacagaagtttatattgttacgttttgaaattctgcatctggtaggtccaaggtagtttgttgttagaagtagcaggatcgccttaataataataatagttttgtagcatgaagcctgagcattgtccaaagtttggaaatgtgaacgctgatagtcacatctgtccatctttccacatttctaggatgctgacagacagcaccaagaagtaattgcaatttatcggacacaccttcttagtgctgcacaggtaaagaactacttctcctttggaaagaatattgctttagagataataattttttattttcaaataaatttatgtgaaagtaattgatgtttaaagtagctgcaccccctatgcttatttaaaaataattatgtt

SEQ ID NO: 325740 - DNA, 6853 bp, Homo sapiens
  misc_feature (626)..(626): n is a, c, g, or t
cgcaggtggcaggcaggtggggctggtacagcccgcgccgcctctgctgcagccgctgccgtctactccttgcgcgctggcactccgcagcctttaaggttcgcgcgggggccaggcaagagttagccatgaagagcctcaagtcccgcctgaggaggcaggacgtgcccggccccgcgtcgtctggcgccgccgccgccagcgcgcatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacaggctttcagcttttctctagtgagaggaacctaagcatttgcaaaccctgaagagaaagtaatcaggtaccttgagcaattctgatcatcatcctgtgtcatttttgtacctctcacctgaatctgaaagctacattttttaaaaattttgctttaagttctgagatacatgtgctgaatgtgccagtttgtacataggtatacatgtgccgtggtggtttgctgcacttatcatgaaagttatattaaagcttgttttccttttcaatccatctgaattaatatgttcatatatgggtcatgtctgttgacacttttccatctggagcaactgttccagccttcttccctgtgcctcatataacctaagtgtgagtagagtgaaaaaaaatgtacactgctatgactgtactagccatctcacacagaatcagagaaaaatgatttctgaaatatatagatatttaaaataaaaagaattattgaatattaatatgggaattgttctctgctcagtgctctaggaaatattgaagtgaatacaaggagttaatattctactaggaacagaaagacacactgctcctaattactgtgtttccgtcatttattgaatacacttactaaatatacgctgtaaataggactttttttttttaatactaaggcacatgtaatctctgttttcaagaagcctacagtatagttgcaaatgtaagactcactcagttgtttgttcacagatatctgctgaacatctacaacatgccaactactgttctaagtgctgggaatattgtagtgtacgaagtctctgcccttatggaactcctagcttagtgagagatgaacaataagcaaaggaatatttagtatcatagcagatgctgtgaagaaaaacaaaacagaattaagggatgaagagggagtgggtggaagtctgtgggagaagcctcacaggctgagggaagggcaggtgcccagcccctgatgagggagcaggttagacatgttcatggggcagcagcagacaagtgtgacaggagcgatgtgcccatcgtggagggagcagaagaagctgctaaagtaacaaagggctagattaagaaggaccttgtatgataaggactattgatatgtacccaccagtgactaccagatggcggaaggcaggacgtgtgcaccccaatcagtggtgcacgtgatcagatcgctgctaagtggagccagaggtgcaagagaggttcttttagtgtgctaataacaaggcttgtcaggaagatggatcttaattaaaggatgcggttgatttagtatgtctgagttaggatatagtggaggcagtgggtgaggatgctgaagtgaaggctggaaatgaaagtggtatgatcaggtgagctgtgagaagatgtcagattccacttgaagaacagtcctttggtagaaggaatgaggctgtaaacatagttagggccaaattgtggatatagaatatcttttaaatgggagttgttcctctagttctagatccaaactcatttgaatgatagtttaaaaacttgatcaagcaaaggtaaacaaataatacaaaacatgagaaaatcatctcgaagaattaaagcagtagttttttttttaacctaattaggaagaaataaatagctttctacattagttattgtggagatttaaagatcattttggtttttttgaaaggggggttattctcttgtttaataattatgttgtttttgttaaagcaaatctctaagctggaataaagtttcaaagcagtaagttacaaaaacagaacatacacccaaccaagttatttaaagacctttttatattgctcaggtcagagggactgtctgtctcttccttaccatacctcttgatattttattttggtggtgctcagagaagtaaataatttctgtattgtctttacaaattaatgtgacttccccttcctcttcctttttttttttttttaagttgagttcttttagtagttggcaatgcagtgctttatagcccaacttttgttatgcatttattacaaattctttttaaaattttgtgactttagttaaaataaatccttaataatattttaaaatttgttattatttagtatttttaaataagttatacttgatttatttaaaacatagtcttaaaggtcctttccattttggagttttaaatagaaacactgccaccttgtgttatgtgcagctaatgttggataaactgaaaatcactaactgggtgtattgccaattgaggaaaatatacttttctgtattcttacacttgctgacccgtgttttcttatgttttaccaaagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttct

SEQ ID NO: 325741 - DNA, 4651 bp, Homo sapiens
  misc_feature (829)..(829): n is a, c, g, or t
tgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaacctgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaagcaagagaatgacaagttaaagaaggagatttttacccttcagaaagatttgagagataagacagttctcattgagaagtctcatgaaatggaaagagcattaagcagaaaaacagacgagctaaacaaacagttaaaagacttgtcacagaaatacacggaagtaaagaatgtgaaagagaagctagtagaagaaaatgccaaacagacttctgagatacttgcagtgcaaaatcttttgcaaaaacaacatgttccattggaacaggttgaggctctgaaaaaatctcttaatggcacaattgaaaatctaaaggaagaactgaagagtatgcaaaggtgttacgagaaagagcagcagacagtgaccaaactgcatcaattgttggagaatcaaaagaactcttctgtacccctggcagagcatttgcagattaaagaagcatttgagaaagaagttggaatcataaaagccagcttgagagaaaaggaagaagaaagccaaaacaaaatggaagaagtctccaaacttcagtcggaggttcagaatactaaacaagcattaaaaaaattagagactagagaggtagttgacttgtctaaatataaagcaacaaaaagtgatttggagacacagatttctagcttaaatgaaaaattggccaatctgaatagaaagtatgaggaagtatgtgaggaagttttgcatgccaaaaagaaggaaatatctgcaaaagatgagaaggaattactgcatttcagcattgagcaagaaattaaggatcagaaggaacgatgtgataagtccttaacaacaatcacagagttacaaagaagaatacaagaatctgctaaacaaatagaagcaaaagataataagataactgaactgcttaatgatgtggaaagattaaaacaggcactcaatggcctttcccaactcacctacacaagtgggaaccccaccaagaggcagagccagctgattgacactctgcagcaccaagtgaaatctctggagcaacagctggccgatgctgacagacagcaccaagaagtaattgcaatttatcggacacaccttcttagtgctgcacagggtcacatggatgaagatgttcaggaggctctgctccagatcatacaaatgcggcaggggcttgtgtgctagccgttagcactgactgccagtatctgttttatcttgctggtgctgaacattctttgtgcaactccatggtctttctgggccttactgtgctggtataattaaaataaaatatattttgttct

SEQ ID NO: 325742 - DNA, 6665 bp, Homo sapiens
  misc_feature (829)..(829): n is a, c, g, or t
tgcagtgttgaggcagcaggatgcagagtgctgttcaagttttccagtggggtccctcaaagggacaactttgaaagatagctagcttccaaagaataagaaatagatagagttactgtacctgacttggggctgctcttaatcaagttctgcattgcaaggaagataatattcgagcgttatgaaggcggagaaggatcctgaagacgaagaaaatatcgttagagatccaagctaagtgtagcacagcatgtgagggactgagtcacttgtcaggagtttgtctgagagtttgctttgtgagcttacagagatttgtaacttaatgcaaagtagtttgccattagcaacaagaaactaaatcctgtctatgatgaactgttggttttcttgtactcctaagaacagacatgcagcagattggaataaatatgatgaccgattgatgaaagcagcagaaaggggggatgtagaaaaagtgacgtcaatccttgctaaaaagggggtcaatccaggcaaactagatgtggaaggcagatctgtcttccatgttgtgacctcaaaggggaatcttgagtgtttgaatgccatccttatacatggagttgatattacaaccagtgacactgcagggagaaatgctcttcacctggctgctaagtatggacatgcattgtgcctacaaaaacttctacagtacaattgtcccactgagcatgcagacctgcagggaagaactgcacttcacgatgccgcaatggcagattgtccttctagcatacagctgctttgtgaccatggggcctctgtgaatgccaaagatgtagangggcggacaccacttgttctggctactcagatgagtaggccaacaatatgtcaactgctgatagatagaggagcggatgttaattccagagacaaacaaaacagaactgccctcatgctaggttgcgaatatggttgcagagatgcagtagaagtcttaattaaaaatggtgctgatataagcttgctggatgcgcttggccatgatagttcttactatgcaagaattggtgacaatctggacattctaaccttgttgaagactgcatcggaaaataccaacaaagggagagaactttggaagaaagggccatctttgcaacaggctttcagcttttctctagtgagaggaacctaagcatttgcaaaccctgaagagaaagtaatcaggtaccttgagcaattctgatcatcatcctgtgtcatttttgtacctctcacctgaatctgaaagctacattttttaaaaattttgctttaagttctgagatacatgtgctgaatgtgccagtttgtacataggtatacatgtgccgtggtggtttgctgcacttatcatgaaagttatattaaagcttgttttccttttcaatccatctgaattaatatgttcatatatgggtcatgtctgttgacacttttccatctggagcaactgttccagccttcttccctgtgcctcatataacctaagtgtgagtagagtgaaaaaaaatgtacactgctatgactgtactagccatctcacacagaatcagagaaaaatgatttctgaaatatatagatatttaaaataaaaagaattattgaatattaatatgggaattgttctctgctcagtgctctaggaaatattgaagtgaatacaaggagttaatattctactaggaacagaaagacacactgctcctaattactgtgtttccgtcatttattgaatacacttactaaatatacgctgtaaataggactttttttttttaatactaaggcacatgtaatctctgttttcaagaagcctacagtatagttgcaaatgtaagactcactcagttgtttgttcacagatatctgctgaacatctacaacatgccaactactgttctaagtgctgggaatattgtagtgtacgaagtctctgcccttatggaactcctagcttagtgagagatgaacaataagcaaaggaatatttagtatcatagcagatgctgtgaagaaaaacaaaacagaattaagggatgaagagggagtgggtggaagtctgtgggagaagcctcacaggctgagggaagggcaggtgcccagcccctgatgagggagcaggttagacatgttcatggggcagcagcagacaagtgtgacaggagcgatgtgcccatcgtggagggagcagaagaagctgctaaagtaacaaagggctagattaagaaggaccttgtatgataaggactattgatatgtacccaccagtgactaccagatggcggaaggcaggacgtgtgcaccccaatcagtggtgcacgtgatcagatcgctgctaagtggagccagaggtgcaagagaggttcttttagtgtgctaataacaaggcttgtcaggaagatggatcttaattaaaggatgcggttgatttagtatgtctgagttaggatatagtggaggcagtgggtgaggatgctgaagtgaaggctggaaatgaaagtggtatgatcaggtgagctgtgagaagatgtcagattccacttgaagaacagtcctttggtagaaggaatgaggctgtaaacatagttagggccaaattgtggatatagaatatcttttaaatgggagttgttcctctagttctagatccaaactcatttgaatgatagtttaaaaacttgatcaagcaaaggtaaacaaataatacaaaacatgagaaaatcatctcgaagaattaaagcagtagttttttttttaacctaattaggaagaaataaatagctttctacattagttattgtggagatttaaagatcattttggtttttttgaaaggggggttattctcttgtttaataattatgttgtttttgttaaagcaaatctctaagctggaataaagtttcaaagcagtaagttacaaaaacagaacatacacccaaccaagttatttaaagacctttttatattgctcaggtcagagggactgtctgtctcttccttaccatacctcttgatattttattttggtggtgctcagagaagtaaataatttctgtattgtctttacaaattaatgtgacttccccttcctcttcctttttttttttttttaagttgagttcttttagtagttggcaatgcagtgctttatagcccaacttttgttatgcatttattacaaattctttttaaaattttgtgactttagttaaaataaatccttaataatattttaaaatttgttattatttagtatttttaaataagttatacttgatttatttaaaacatagtcttaaaggtcctttccattttggagttttaaatagaaacactgccaccttgtgttatgtgcagctaatgttggataaactgaaaatcactaactgggtgtattgccaattgaggaaaatatacttttctgtattcttacacttgctgacccgtgttttcttatgttttaccaaagcgaaatttgacacacatgcaagatgaagtaaatgtgaagtcacatcagagggagcatcaaaatattcaggatttggagattgaaaatgaagatttgaaagagaggttgagaaaaattcagcaagaacaaagaatacttttggataaagtcaatggtttacagttacagctgaatgaggaagttatggttgctgatgatctggaaagcgagagagaaaagctgaagtcccttttggcagctaaagaaaagcaacatgaagaaagcttaaggactattgaggctctgaaaaatagatttaaatattttgagagtgatcatttaggatcaggaagtcatttcagtaaccgtaagtataaaagtatggattatcattacagttcacctagttcaagtaaagaagaatgtttattcttacttgtttaactatacaggaataactgtacaagatattcctgctgctaaacttcatcagcacatggaactaggaagacgttaagatgactattgtaacttctaacatattctgataattactgaagctctgattctccttagctacctgtattttaaaattgtatattgtatgaattaccaaatttgccttgttgattagtagacatagacatttgtcttgtgatatttagggttcatttttttatggaaagaacataaacatagttttctaatttggagaaatcggtcttaatgcaagtaggcattttaaaattacatttatgaattatttttagaccctacataatcttttttattctgcaatgttaaacagtttctctagaaaatctgtttttgtttcctagtgactattaaactattctctcctacaacagtaatatttatgctataaatttaaatcatcatttttgttttgattgattataagatatatgttttattatcatgtagcctagtttaagagtcctcaatatttctgaagttttagtgattctgctgagagagagcatagaaaaaaataagaaaaaaaaaaaccaacctagtatctgttgttcagtagattgtaggtacttctgtttatagaaataataaggggaaaatgggtattttagaatgaggatacttttgtgttgtacctcttgcttctcttttatttgaataataaaggaaataacatcaaattaatgtttagcctactttagtatggatattgaagttaaaatgtcattcatttgcatttatttaggaaaagaagatatgcttcttaaacaaggtcagatgtatatggcagactcacagtgtacttccccaggtataccagcccatatgcaaagcagatctatgttaagacctctggaactatctttacccagtcaaacgtcatactctgaaaatgaaattttaaagaaagagttagaagcaatgcgaactttctgtgagtcagcaaaacaagaccgactgaagctccaaaatgaactggcacacaaagtggcagaatgcaaagctttagcattagaatgtgaaagggtcaaggaggattcagatgaacagataaagcaattagaagatgcattaaaagatgtgcagaagaggatgtatgagtcagaaggtaaagttaaacaaatgcagacccattttcttgcccttaaagaacacttaacaagtgaagcagcctcagggaatcacagactaaccgaggaactgaaggatcagttgaaagacttgaaagtaaaatatgaaggtgcttcagcagaagtggggaaattaagaaaccaaatcaaacaaaatgagatgatagtagaagagtttaagagggatgaaggcaagctgatagaagaaaataagcgattacagaaggaacttagtatgtgtgaaatggagcgagagaagaaaggaagaaaggtcacagagatggaaggccaggcaaaagaattgtcagcgaagttggccctttccattccagctgaaaaatttgaaaacatgaagagctcattatcaaatgaagtgaatgagaaagcaaaaaaattagtagaaatggaaagagaacatgaaaaatcacttagtgaaattagacagttaaagagagaacttgagaatgttaaggccaagcttgctcagcacgtcaaaccagaggaacatgaacaggttaagagcagattagaacagaaatcaggagaacttgggaagaagatcactgagttaacattgaaaaatcagacactacaaaaggaaattgaaaaagtttatttggataataagctcctcaaggagcaagcacataacttaacaattgaaatgaaaaatcattatgttcctttaaaagtaagtgaagacatgaaaaagtcacatgatgcaattattgatgatcttaatagaaagcttttagatgtaacacaaaaatatacagaaaagaagttggaaatggagaaattgctactggaaaatgacagcttaagtaaggatgtaagccgcctagaaactgtgtttgtacctcctgagaaacatgaaaaagagataatagctctgaaatccaatattgttgaacttaagaaacagctgtctgaacttaagaaaaaatgtggtgaagaccaggagaaaatacacgctctcacatctgaaaacactaacttgaagaagatgatgagtaatcagtatgtgccagttaaaacccatgaagaggttaaaatgacactgaatgacacgttagccaaaactaacagagaattattagatgtgaagaaaaaatttgaagatataaatcaggaatttgtaaaaataaaagataagaatgaaatattaaaaagaaacctggaaaacactcagaaccaaataaaagctgagtacatcagcctggcagagcacgaggcaaagatgagctcgctaagtcagagcatgagaaaggtgcaggatagtaatgctgaaatcttggccaactacagaaaaggccaagaagagattgtgacactgcatgccgaaattaaagcccagaagaaggagctcgacacaatacaagaatgcattaaggtaaaatatgccccaattgtcagctttgaggagtgcgagagaaaatttaaagcaacagagaaagaactaaaagaccagttatcagagcagacacaaaagtatagtgtcagtgaagaagaagtcaagaaaaacaaataaaagctgagtacatcagcctggcaga

SEQ ID NO: 325743 - DNA, 453 bp, Homo sapiens
ccttacccttggcaacagggattgtttcatgataggacaaatgttccaagcagggccaaagtccttccctccacgtgagctagccaagaagcctgcctcttgcctctagggtcactgtgtcaaagaatgttcacctgggggacctcccatctgcagcactaaaggacatgctgacacagagcagagggagtgtcctggtttaagtcgtggatccaccttggtggttcctagtaatgaaagccagtccatcacattttagcttaagattattttgagtcagttttatcatgtgcaactgagaggatcatgacaaatacacttgaccttgttctgccattgcccctgtgctttatctatttgtatacattacactatagggtagttgtaattgcctgtttatttgtctgtgtctcccactagaagttcttaattgcaccgtcaacattatgtatc

SEQ ID NO: 325744 - DNA, 572 bp, Homo sapiens
cctctctcctgcccatgagaagagctgcagcgtggcagtctcacccctccctgctttgtaccttgacccccacagcacgagttcatacctaaggactccacagttcgtcatgctgctgtggaaggtgccctttcaaactctcatgcccattccctcaattcagacttcccctcatgcctggaaaatggcagttgtccccacaaacagggaaggacacagaggccctgggagcaagttgcaccttcatggtggcaaagccttgcttcccggttcccccaaggtctccagcagcccttccccctagctgagaacagagggctgacagggaggttccagagctggtatggactctggagtcaggtcagctttcaaatcccagtcctgcccagtcctagtggtgccagtgcgggcaggcggcctcacagctctaagctcatctgtaaaattagcattcaacagcatcagcctcctaagtttgtgaggactggatacaagaacagaagttaagctttcatcaccaagcttggcatacagcacacagaaaactccaaaacttcccagattgccactcc

SEQ ID NO: 325745 - DNA, 105 bp, Homo sapiens
gaagatggtatttgaagggatacatctgttatgtgacccactaaacaaaggagccctgataaaatagccctttcggtctcaagtcacctggttaaggttaatgca

SEQ ID NO: 325746 - DNA, 2646 bp, Homo sapiens
gcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatttgcaggtgggtagggcctccagcccacaccacccagacctaggcttccctcttctcaggatccaccacagggttaggggacaggaagcctgttctattctcaataaatcttacaaaattccaaaaagactttcctgtg

SEQ ID NO: 325747 - DNA, 2252 bp, Homo sapiens
actcactatagggctcgagcggccgcccgggcaggtagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccacttttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtg

SEQ ID NO: 325748 - DNA, 4386 bp, Homo sapiens
gcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccagggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtg

SEQ ID NO: 325749 - DNA, 4263 bp, Homo sapiens
actcactatagggctcgagcggccgcccgggcaggtagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccagggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtg

SEQ ID NO: 325750 - DNA, 3964 bp, Homo sapiens
gcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcaggatccaccacagggttaggggacaggaagcctgttctattctcaataaatcttacaaaattccaaaaagactttcctgtg

SEQ ID NO: 325751 - DNA, 3308 bp, Homo sapiens
gcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgttctattctcaataaatcttacaaaattccaaaaagactttcctgtg

SEQ ID NO: 325752 - DNA, 3867 bp, Homo sapiens
actcactatagggctcgagcggccgcccgggcaggtagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcatcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccagggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtg

SEQ ID NO: 325753 - DNA, 2140 bp, Homo sapiens
catgagggcttggacaaggacgggtgggcttcttggaggagttggcactggggctgggccttgaaggatctgggggaggatgacactaggaacgaagaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccagggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaagactttcctgtg

SEQ ID NO: 325754 - DNA, 2554 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325755 - DNA, 814 bp, Homo sapiens
ctcttctaatactcagtacatattcaaatttctccaaatgaaccaaaaatgtcctttacgcttatttctccaagttggcccccaactcaagcccttgcaatgtgtctcttggttatattcttcgggttccttttaatctggcataggccctttcataggactctgactcgacaaagagaactggccagctgtcctgaaggaaggcccacttcctgtatttgcctggttccctgtggtgtcattttacttgctcctcaattccccttacttcctgtaaacatcaaactcaagatgccatagaggcaagttaaccaccttgggctagaatacttcatgggcgatagcacgtactttacattgcatcacataggaatccacataatacctggttgacgcaacatcagtccaactgaccacaaagcaactaggggtttcagagggagtacacgtaaggggcaaaagcagcaacggaatacgacaacggaataagcatgaatacgacctggctacctgaaggaggtaggacggggaaccgagcagcagcaggtggtggaatgccagggaaatccaaccgtgcttcccacgctggcatcgctctgattatgaccaatcctctaatcttattctcacaattagggaggaagaaaaaaaaacaaacccaaaccaaaaaagaagttggtaggtgactctgtgagactactgttttataaagggagcgtttccttttataaaatttagctgagcagatgctaggcagcccacaggaggccactattcccctcagctgtacagtttgggaaaatacctacacacc

SEQ ID NO: 325756 - DNA, 385 bp, Homo sapiens
cctcttgtccagtgagctgggctggggtgggactgcacggcctcttgccctcttgtcacaggctctggtaacagcctttgttgagagctgtgggcagagtcagtgaatctgccgtaaagggtgatggacagtcagttgcagctggaaatcgggaccaaatgaagacctgaccacggggcaaggagggactgcagattgtcctaatgtgttctgttcatttcttgtcgactaaatttgttagaaatgaaaagattgtgctttctttttaggtgtaccaacagtaccgttattgccaccacaagtaaaccagtccctcacttctgtgccaccaatgaatccagctactacattaccagcctgggcaacagagcaagacttcatctca

SEQ ID NO: 325757 - DNA, 346 bp, Homo sapiens
cgtcgaattcgtggtgctgctcggcgaattcgtggtgctgctcggcgattcgtggtgctgctcggcgaattcgtggtgctgctcggcgaattcgtggtgctgctcggcgaattcgtggtgctgctcggcgaattcgtggtgctgctcggcgaattcgtggtgctgctttgatggggcaaatgaaaatgtttggcatgtgctggaggtggaatcaaattctcctgcagcactggcaggtcttagaccacacagtgattatataattggagcagatacagtcatgaatgagtctgaacatctattcgcctaatccaacacctgaaccaccccacgcatgggaccctct

SEQ ID NO: 325758 - DNA, 2820 bp, Homo sapiens
ctcttctaatactcagtacatattcaaatttctccaaatgaaccaaaaatgtcctttacgcttatttctccaagttggcccccaactcaagcccttgcaatgtgtctcttggttatattcttcgggttccttttaatctggcataggccctttcataggactctgactcgacaaagagaactggccagctgtcctgaaggaaggcccacttcctgtatttgcctggttccctgtggtgtcattttacttgctcctcaattccccttacttcctgtaaacatcaaactcaagatgccatagaggcaagttaaccaccttgggctagaatacttcatgggcgatagcacgtactttacattgcatcacataggaatccacataatacctggttgacgcaacatcagtccaactgaccacaaagcaactaggggtttcagagggagtacacgtaaggggcaaaagcagcaacggaatacgacaacggaataagcatgaatacgacctggctacctgaaggaggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325759 - DNA, 2503 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccagctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325760 - DNA, 2410 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325761 - DNA, 2373 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtatgttgcagatctcaccctctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325762 - DNA, 2511 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325763 - DNA, 3217 bp, Homo sapiens
  misc_feature (998)..(998): n is a, c, g, or t
  misc_feature (1079)..(1079): n is a, c, g, or t
  misc_feature (1401)..(1401): n is a, c, g, or t
aaaactgcaattcagccaggcatggaagatcacacctataatctcaggactttgggaggcctagctcctcctttaccagtctgatcatgccactgtgctacagcctgggcaacagaataataaattgtcttaataaataaataaataaataaataaataaaattaaaaaggctgaagttggctactgcctgctcacccagcttttggtggcagtggagataatagatgatgtggcaggagaagggcacagaggtattcatgcatggcctactctgaaattgtcaagttgtttgggaaataaaagacatcatgatggaaacataagttggaacctgattatggagagccttaaataccacggtcaggacttccgatatattttgagcagttgaggctgtgataattgtatcagtaaggggttttgggttcaaatggtaaaaactagctgtcaccatcataagcagataacatacttaatgatatggattagctcatataatcaaggaaacagctgaagaaccagatgtagaaaggacaggactcagaaaacctagggatttagataggaagaagtatttggcaatgtcatcagcattcattctactaaacccatttttgttttttctctgactcccaaggtttgcagccatgggcaagagaaattggcctggctttgaccatgagccattcccttggtttgggcagggcagacactctgattgacaatcctaccagcactgcacacaacagcagagaagtaattccccaaagggaggaaagagaaaggaatgttgagaagacatcagactagaaagaagcaatgtgatcacatcttactagaaaaatgcctctggtggcagtgggaggatgaaatagaagagatctgggttgaacatacatgactgatttgtgtcaggttctgaaagagaactatggaatgtgtaaatgatgtcatcatacagacgtgcttagagctcttcagtggaaaggctgtatcnatgtcatttgtttagcgagtaatcatcaaatgtctgccatgtgccggcagctatgaaggcagtaaacagacaaggtctctncccttcaggaccttaacattttgttgggggagatagatagtaaataaatatgcagtgtgttggatggtgatgaattcttgaaaaataaaggagtaagggtgatatccacagtggagggcagggtgttgttttctgtggggtggtctgggagacctctgcttcattatctaaaagaatagaaatttgtttgtttttatcttttaaaatctcaaagaagggagtgcatgttcagggcaacttgaatctatgctcttgggttacccgccccccccaaaaaaaacacctcaaagaaatacaagctgtgatagataacaacgttaanaaaaaaatgtttttatagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325764 - DNA, 2004 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagaga

SEQ ID NO: 325765 - DNA, 2338 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacgtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325766 - DNA, 1958 bp, Homo sapiens
cgttgagaatatacccttctcactcacatttttcacacacctcgcacagacctaacactcaccacaggcatcctctgttctgactgtgcacacagccgtcactgacacactgttgtgacgcgatattcacaccttattctgcatgcagagacgcagacagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325767 - DNA, 1737 bp, Homo sapiens
gaggtgatctagaggatcccttcagtgatgggtggtgcacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325768 - DNA, 1810 bp, Homo sapiens
cctcttgtccagtgagctgggctggggtgggactgcacggcctcttgccctcttgtcacaggctctggtaacagcctttgttgagagctgtgggcagagtcagtgaatctgccgtaaagggtgatggacagtcagttgcagctggaaatcgggaccaaatgaagacctgaccacggggcaaggagggactgcagattgtcctaatgtgttctgttcatttcttgtcgactaaatttgttagaaatgaaaagattgtgctttctttttaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325769 - DNA, 1207 bp, Homo sapiens
  misc_feature (1187)..(1187): n is a, c, g, or t
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatctggcccgcacatcctntggcccgcacatccgtactg

SEQ ID NO: 325770 - DNA, 978 bp, Homo sapiens
aattccattccagcgtacaattccagttcgcagctatattcaattccattccagcgtagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325771 - DNA, 694 bp, Homo sapiens
ctgatcgcttaagatccgttaaggctgatccgcttaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325772 - DNA, 1628 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggacttcgcattctcatgggttatctcattcacatggtctccacagcattcacacatcacacagcaccacatgcaccactccttcacaggcatctgcctgcacaagccaaacgtctgcacaaagccgtgtacacagcatgctatcatctcatcagaccagccaacacacccatggcgcaacctggcggagcagcacctcaaggtccaccacccacagctcaaccctggtggcgcgcgcgcccccagggcatctcatcaggcgcagctgccagccacattccgcctattccttgcgcaagccactactcgcactgcgggggccacaaccgtgcacacacaactgctctctgcgcccagtgggtggcactgcgcaccgcggcttggcgcaaacccccacaccacatgccactccccgctgccacagccccacaccctgcgcccaacgcgactcaccacaacagcacccccgaaccacaccaccggcggcgcaccgcacatcacacccacacccaagccgccacggccccagcacccaccccaacgacccccacagggccgcgccgggccagccccacctggcaaccccgcacacccccggcacagagcccacgagcacaccacacacactcccgcacacacacacacacgcacccgacacacgccccacgccaacaacccccaacacacgcccaccaccctcgccccacccgcctcgctaaccccaacccccacacacgccaacccaaccccggcacctcacacacccccgcggcccccgccaccccaccacgaccggcaccccccacgccgccccccacccccccacaacacctcaccctccccccccctcggcgccgcgcgcgcggccaaccccacaacgaccgccccacgcaccccgaacagcggcaaacacgcgcccgccacgacacccaaacgggccccaacactacaggcaacacaaacacaaccccagcgcacaccctccccagcacacaccgcacaccacccaccaccatcccgacgcaggacccaccacacactgaaaacaagaaaacaggcgacccccaggccaccacaccacaaccgccaacacccacgaccgcccaacgccggaaacccgacaccaacgagtgcccaccacgcacccagcaccacgacgcgacgagacctcccagcccccatcacccaccgcccccacgcaaacacaccgacgccgtcaagcaccacgcacaccggaacacccgcagctacactgcgccccaccaaaacacgacaacaacgcacaccccgccacacccacaagcggccccaccaccgacgaacccggacgacaccgcgct

SEQ ID NO: 325773 - DNA, 2817 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaaaaaaaaaaaaaacacgaacaggaacgaaagcaacacaagagccaaacaaaacatcgtgctcgcgggccctcgcacgccgcagaaaagttctgcagacccagcgtggtggggcgcgcgccccagtgtgatgtgtacacgtggcacagcgtcccggaggaaactgcgccagcaaccgagcgtggcttccccccaaaaaaagcgcggcgagcggcgtcggcaacccgcaggggtcgcgcgagggatcacagagaccggcagctaca

SEQ ID NO: 325774 - DNA, 2430 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctccctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325775 - DNA, 2357 bp, Homo sapiens
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325776 - DNA, 2809 bp, Homo sapiens
cgggctggaggcggggccggccgcggggaggcggaggcccccatgggctccttcacggggcagccaggcccgatcccgcgaaggagcggcggtcgcgggcgctgccttggtcgaggctggttccggaggccgctcgcatcccacctccgcggagcgccctgggcacggggtccgcggctgtaggaggacgggctggagctggaggcggctgccggcgactcggccagggggcggccctgggaaggggggacaaccttgctctttttccgcacggccttctctctcctccaccccccctcatttttagcttccaaagttaggaagggcgcggaggcaacgtctccaaagtggtgactgtgaaggcagcctttgcgctttcctaggagagggatccggacccgcagtccggaggcggggcctgcggcggcaggtgttaaatcacctcggcgccggccgagtggcctgaaagaccagcagggcaggagacggaaaaccaaatggcctggaagtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325777 - DNA, 1522 bp, Homo sapiens
agcgagcggacctcataggtcgcaggctcacttctgtgccaccatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccaccaccgttgaggacagagtcggcgactccaccccagtcagcgagaagcctgtttctgcggctgtggatgccaatgcttctgagtcaccttaactttgaaccattctttggaattggcgtggtatatttaaccacgggagcgtgtctggaaacgcaaactatcattaatttcatactagtttgtaccgtatctgtaggcatcctgtaaataattccaaggggaaaactaaacgaggacgtgggttgtatcctgccaggttgagtggggctcacacgctagggtgagatgtcagaaagcgcttgtattttaaacaaccaaaaagaattgtaagggtggcttgctgccaggcttgcactgccgttcctgggggtgtgcatcttcgggaaaggtggtggcggggcgtccactaggtttcctgtcccctgctgctccttccgtaagaaaatgaaatattctatgcctaatactcacacgcaacatttcttgtactttgtaagtcgtttgcgagaatgcagaccacctcactaaactgtaaacggtaaagagatttttacttttggtctccgtgagtcgcatctctactaaggtttacacaggaattccacctgaagacttgtgttaaagttctacagcgcgcactgttaactgaacgtctttttcttcagcctatacgcggatccttgttttgagctctcagaatcactcagacaacattttgtaactgctgctgttgctttctacatacaccttataaagtgacatttcaaaagaaataaggtgccacagttttaaaccagaaggtggcactctgtggctccttgtagtattatagctatactgggaaagcatagatacagcaataaagtacagtaattttactttttttcttgtgttacatctaaattacaacccttaattgccacgtgtgcacttactactctccagtatgtcttattactctccagtatgtcacgcatctttaacttttcacgtcctatgtttgctttctcccatttttaagagatggtaagttaactggaattgatttactgaatgaaattaaatgcagatatccctgtttttgaaataagaaaaaa

SEQ ID NO: 325778 - DNA, 1666 bp, Homo sapiens
  misc_feature (1549)..(1549): n is a, c, g, or t
gtggcgctgtctgcggcgtcgcagcggcccgggctgcagcagagacgatctcccggcgggctgtgcggcccggctctccggcggcagcgagtgccacgtcccaagtgctacgcggaggattagagcaggcggtgcgctgggggcgggagcagcgcggagcccggctcggccacaccgatcgcccgccgccatgggctcctcgcaaagcgtcgagatcccgggcgggggcaccgagggctaccacgttctgcgggtacaagaaaattccccaggacacagagctggtttggagcctttctttgattttattgtttctattaatggttcaagattaaataaagacaatgacactcttaaggatctgctgaaagcaaacgttgaaaagcctgtaaagatgcttatctatagcagcaaaacattggaactgcgagagacctcagtcacaccaagtaacctgtggggcggccagggcttattgggagtgagcattcgtttctgcagctttgatggggcaaatgaaaatgtttggcatgtgctggaggtggaatcaaattctcctgcagcactggcaggtcttagaccacacagtgattatataattggagcagatacagtcatgaatgagtctgaagatctattcagccttatcgaaacacatgaagcaaaaccattgaaactgtatgtgtacaacacagacactgataactgtcgagaagtgattattacaccaaattctgcatggggtggagaaggcagcctaggatgtggcattggatatggttatttgcatcgaatacctacacgcccatttgaggaaggaaagaaaatttctcttccaggacaaatggctggtacacctattacacctcttaaagatgggtttacagaggtccagctgtcctcagttaatcccccgtctttgtcaccaccaggaactacaggaattgaacagagtctgactggactttctattagctcaactccaccagctgtcagtagtgttctcagtacaggtgtaccaacagtaccgttattgccaccacaagtaaaccagtccctcacttctgtgccaccaatgaatccagctactacattaccaggtctgatgcctttaccagcaggactgcccaacctccccaacctcaacctcaacctcccagcaccacacatcatgccaggggttggcttaccagaacttgtaaacccaggtctgccacctcttccttccatgcctccccgaaacttacctggcattgcacctctccccctgccatccgagttcctcccgtcattccccttggttccagagagctcttctgcagcaagctcaggagagctgctgtcttccctcccgcccaccagcaacgcaccctctgaccctgccacaactactgcaaaggcagacgctgcctcctcactcactgtggatgtgacgccccccactgccaaggcccccgcgcctctgctgagaacacagcatcatcgtacccgccagcatctcagacacaaactgcctgggccctattaaggaccgtcatctgggcttagnccgtcgtgagacaggttagttttaccctactgatgatgtgttgatgccatcgcattcctgctcagtacatatcgttactctcatactagcttgtaccgtatgtgctcggcagcgagg

SEQ ID NO: 325779 - DNA, 612 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgttacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaaggtgttaccgatttggaaactagaaatcacctttttacttaaaaa

SEQ ID NO: 325780 - DNA, 6385 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctgagcctaggagcatgtataaattttatttttattattattatacattaagttctagggaacatgtgcacaacatgcaggtttgttgcatatgtatacatgtgccgtgttggtgtgctgcacccgttaactcgtcatttacattaggtatatctcctgatgctatcccttccccctcccccgacctcacaacaggccccagtgtgtgatgttcaccttcctgtgtccaagtgttctcattgttcaattcccacctatgagtgagagcatgtataaattttaaaatcaatacaagctactccaatttccattttggaaatt

SEQ ID NO: 325781 - DNA, 5883 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctga

SEQ ID NO: 325782 - DNA, 4236 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgttacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaagtcaggagtttccccaacccctactgcccgcttgcttcccacgtcgagccacgctgattggcctgttggtttatgggagggatcggggaggagaatgccgtttcaaggttctctgctccctggatttgcttcaggagttttgaagtttagtgctggacagcagcaatcacattctttcagagatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctga

SEQ ID NO: 325783 - DNA, 5348 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatctatcaatatcagctagactcatacttttaacattcaattcacttgctcttgatgtgcttcccaataatgagactagatatgggatactctagtgc

SEQ ID NO: 325784 - DNA, 3194 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccagctgagcatgccatgtgttgaactccagtgttggaggtgctgtgttggggcacagagatgagtagtacatagttgccacagcggaatcaagcagcagaacagggcacaaacacaggaagttctaatccagcaggatgagatcatgctgataatattgataactcattaaacttatttttggcatgctttggcatatcagactct

SEQ ID NO: 325785 - DNA, 3307 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtaagactgctgaattctccctcacatcagaatctcaagttgcagagaaggtggatgtgatgctgaatagtgtccagggaatctgcagccgtaagagaagatagattctctgttacaggggttacagggatgaaaaatgccttgagagtatcagaaagcttttattgactaccttgttgtctacaa

SEQ ID NO: 325786 - DNA, 3143 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtgacaaagttactggaaatgcagccaacaaaagccccagaaaaagatcctgaacaacctcccaaaggacgtgtggacagttgcgtgtcagatgcagccgtgccagcccaagaccccagcaacagcgatccagctgagcatgccatgtgttgaactccagtgttggaggtgctgtgttggggcacagagatgagtagtacatagttgccacagcggaatcaagcagcagaacagggcacaaacacaggaagttctaatccagcaggatgagatcatgctgataatattgataactcattaaacttatttttggcatgctttggcatatcagactct

SEQ ID NO: 325787 - DNA, 1719 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtggcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaaggtgttaccgatttggaaactagaaatcacctttttacttaaaaa

SEQ ID NO: 325788 - DNA, 6068 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctga

SEQ ID NO: 325789 - DNA, 1955 bp, Homo sapiens
ctctgtttgccatcatttctggaaatcttggctcagaagttgcatatattagcaataaagaggaaagggttagaatggaaacctgcagggcctattttagtaactggttgactactgctactctttcctgcactagggccctagctgttccctggcagcattcaaagccaacatgtggcaagcaagggcaccacatgtacccttactggaaatttcatctatatctgggtccttatgaaaaaagagagagcatgtgtgtatgtgtgtgtgtctctgtctctgtgcttatgtttcatgggccagcaataacagactcacagtacctaaccttttcttaactgggcccatatattgagggatgaccatgatacctctgcttatgagtctctgtcccttgaaacattgatgttatcacttgcagttccttttctggttttatttggaacacaaggggaaaaaatggatgtccaaaaaggatacaccatgaatagcaataatgaaaacttgctctatgccacctgtctgtttaatcttcagcaaatttttaatgagtgcctattatgtgttagctaatctatcctgtgggaatataaccataatacacactgatgccagttttacttagcagaaaccatttcacaagtgcactgtagacatagcttagtgtatgcgttaacattatctatcaagaattgccagaatatacattgtttgggggattgcagggccgagtctttcctggcagctctgaccacagtaagctccccagaataagtatggatattcttgttgtgttttattatcagtacttgccagcccttagtgtgaggctcaaggccataaattacaacctgtttctgctctttgtttctgtaccaggtccaggctgaggttctcatccagtaaaatttctccagcactaagtgtgactgaagcacaagacaagattctttattgtctccaggaaggcagtgtggtaagaaccaaaacccagagaatgtgaggcaaaaatatctgagatgttggtcctgcagttacaggtagttgagatattctctgaagtcagaaatgtcctgctaaatgacttaatcaacgtttggatctccagcttttatgctaaaagtattttctctaagtggtttggaattcctaccagttctgggttggcaggttggcttctcaaccatggtgggtttcggataatggatgacaagataagaaagaaagctagttcctggaaaaaaaaatggatgaccaaaaatgggtgcagaaatgataatcccagggcaggcctgttttacttgcaacttcggtaaaaaataaaatctttcctaaaggagtcatagcatcagttgggttttatacccaaggtacttatgcaggggagaggcagggaaacctagagtgctgcatttgctcccctactgtcagcattccatatgtgatatgccactgactatttcttaggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggtgagtggcgaggtctctgctcccatggagaagggagccagggtggcatccacttggtacttggggtagttggagtttgtaactttgatttctgttccattcagctgagcatgccatgtgttgaactccagtgttggaggtgctgtgttggggcacagagatgagtagtacatagttgccacagcggaatcaagcagcagaacagggcacaaacacaggaagttctaatccagcaggatgagatcatgctgataatattgataactcattaaacttatttttggcatgctttggcatatcagactct

SEQ ID NO: 325790 - DNA, 6708 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctgaaaaaaaaaaaaaaaaaaaaaaaaaaaaaaaaaaaaaaaaaaaaaaaaaaaaaaaaaaaaaaaaaaccacacacacaaaaaaaacaaaaacaaaaacaaaaaagacaaggcggggacccgaacacaccgagggggaggccgacaagatacccacaccacaagaagaccagcggcgccccacaagcaaacaagaaaataaacgaacaagaggagaacgcggcaaaccacacacagaacgactgcacaccggaccgagagaacggaagacacacacactacacagaggggacaaagaagagagaagacacacgccagaacaaaacccacaccccagcgaaaacgaccaaccaccgccagcacacgagccaacaaaacacgaacacgaacagagacaaaactagcgcccgaccaacaacaaacgagcaaacacacagcggcacagaccgagaggcgcaccaacgaccacgcaacgcacgacggagggggaggcacaggcgacaggggcaagacgggcgggcagaggccgagcacgcacaccaagccaaccaggggggacgacacagggacgagagagagacgaagaggcggcacaagagacgaggagggcgacacagacggagaagcggaaaaacacaccaccc

SEQ ID NO: 325791 - DNA, 4054 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgttacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctga

SEQ ID NO: 325792 - DNA, 4003 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgttacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtgacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccataccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagggaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctga

SEQ ID NO: 325793 - DNA, 4964 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctccggcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgcatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtgga

SEQ ID NO: 325794 - DNA, 3327 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtccaggctgaggttctcatccagtaaaatttctccagcactaagtgtgactgaagcacaagacaagattctttattgtctccaggaaggcagtgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaagagttctagggttctgcagaagtgcttctgaagccaacttagaagctcagggaaaactgagtggaccatgacccaaccacagaagttacactttgatcagtttaatatactggggctctaggtaacgctttgtttgaaaaggggctccactctgtttaaaatatgcatttatttctttatattaaaattccacctcctttcttaatt

SEQ ID NO: 325795 - DNA, 2626 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccatttggaaacatggacagtgacagagtagaagcccgtaagagcctcctagaatcattcctaaagcaactctgtgccattccagagatcgctaacagtgaggaggtgcaggagttccttgctctgaacacagatgctcgtattgcctttgtcaagaaaccatttatggtctctagaatagacaaggtgttaccgatttggaaactagaaatcacctttttacttaaaaa

SEQ ID NO: 325796 - DNA, 2284 bp, Homo sapiens
gacccggaagcggtcgccggcggccggccggcggtcatccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgcccacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatcttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagcgagacaccccttgcaggctaagcccaggcctactaatttgctgacagtgacacaagcccgg

SEQ ID NO: 325797 - DNA, 1212 bp, Homo sapiens
gcaacttgcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaaagtaattagtgcattct

SEQ ID NO: 325798 - DNA, 1297 bp, Homo sapiens
gcaacttgcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggtactggtagaggagggtaccgatgagggacccagggggctggaaaggggggagtattgcctcttgttaacgtttgtacccttaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaaagtaattagtgcattct

SEQ ID NO: 325799 - DNA, 432 bp, Homo sapiens
aggagcttcacccagccagtttttgacaggtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaaagtaattagtgcattct

SEQ ID NO: 325800 - DNA, 1307 bp, Homo sapiens
gcaacttgcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtgcgggggaaaaataaaaatacatttatctcgtctatgttattgtgcgtttctctcgttgattattttaccgtactattttctaaaatttgttgggggggggggggcccctacaccaaaatattt

SEQ ID NO: 325801 - DNA, 1123 bp, Homo sapiens
  misc_feature (1031)..(1031): n is a, c, g, or t
  misc_feature (1036)..(1036): n is a, c, g, or t
  misc_feature (1038)..(1038): n is a, c, g, or t
gcaacttgcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgcgaatntgccnancatcagggcaacccaggggagtcgcgccatataccacagggggcccaaacagggccacagaagcctgaggcagtgaatcacgcgg

SEQ ID NO: 325802 - DNA, 1234 bp, Homo sapiens
gcaacttgcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccagaccaggcctcccctctctgcaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaaagtaattagtgcattct

SEQ ID NO: 325803 - DNA, 924 bp, Homo sapiens
  misc_feature (546)..(546): n is a, c, g, or t
  misc_feature (551)..(551): n is a, c, g, or t
  misc_feature (553)..(553): n is a, c, g, or t
  misc_feature (563)..(564): n is a, c, g, or t
  misc_feature (567)..(567): n is a, c, g, or t
  misc_feature (579)..(579): n is a, c, g, or t
  misc_feature (583)..(583): n is a, c, g, or t
  misc_feature (585)..(585): n is a, c, g, or t
  misc_feature (597)..(598): n is a, c, g, or t
  misc_feature (606)..(606): n is a, c, g, or t
  misc_feature (612)..(612): n is a, c, g, or t
  misc_feature (719)..(719): n is a, c, g, or t
  misc_feature (729)..(729): n is a, c, g, or t
  misc_feature (732)..(732): n is a, c, g, or t
  misc_feature (734)..(734): n is a, c, g, or t
  misc_feature (740)..(740): n is a, c, g, or t
  misc_feature (762)..(762): n is a, c, g, or t
  misc_feature (768)..(768): n is a, c, g, or t
  misc_feature (772)..(772): n is a, c, g, or t
  misc_feature (791)..(791): n is a, c, g, or t
  misc_feature (797)..(798): n is a, c, g, or t
  misc_feature (803)..(803): n is a, c, g, or t
  misc_feature (827)..(827): n is a, c, g, or t
  misc_feature (845)..(845): n is a, c, g, or t
  misc_feature (861)..(861): n is a, c, g, or t
  misc_feature (896)..(896): n is a, c, g, or t
gcaacttgcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtgttggggtggtgatganggcgncnaggccgctgnnggncgtgggggtgcngcgncngttgtaggcggnntggctgtngtagtngcggtagttagatcggtgttgggtggaggcggaggagtgaggtggtggagcccggtggagggggcgttggccgccggtgtagcgctggtggtagagggcccggccgnggggggtggnggntnggcggnggggccggcggcggtggggcgnggggtncgcnggggggccccggctgcggngccgtnntttcnggtggcgcagtagctgctggtggntcggggcgcggctgcgcngcttgcgggggggctnggtggaccggcgggggggcagccggtgctgggcangcaggcgcaggctttctttcaggggccc

SEQ ID NO: 325804 - DNA, 951 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaacatcatcaacaccaagatcaaaaggacaagaatccttcaagaaacaggaaaaactcctaaaacaccaaaaggacctagttctgtagaagacattaaagcaaaaatgcagcagtttggaaaagcgcatgacgccgggcacgcacggtcctccgccccgagggaacagcgacaggggacacaacgcaccggaggccaaacaagagcc

SEQ ID NO: 325805 - DNA, 1217 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatgacaagaatccttcaagaaacaggaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 325806 - DNA, 1303 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaacatcatcaacaccaagatcaaaaggacaagaatccttcaagaaacaggaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 325807 - DNA, 824 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagcagctgaaaggagctattgaaaaacactgacatggaatgctcctaaactgatcgcaaagtatttgtgggacgacttaagtctcgtacagaacgagaagctgaacttggagctagggcaaaagaattcaccaatgtttacatcaagaatctcggcgaagacatggatg

SEQ ID NO: 325808 - DNA, 1151 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactcttaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaacatcatcaacaccaagatcaaaaggacaagaatccttcaagaaacaggaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 325809 - DNA, 1180 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaagatgcagagtcagaagatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaacatcatcaacaccaagatcaaaaggacaagaatccttcaagaaacaggaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 325810 - DNA, 848 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggaaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 325811 - DNA, 1226 bp, Homo sapiens
tttgtccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagctgtggaggagtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaacatcatcaacaccaagatcaaaaggacaagaatccttcaagaaacaggaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaagaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagta

SEQ ID NO: 325812 - DNA, 143 bp, Homo sapiens
tgtgctcatatccctacgacttcaaataccactgacatgctaatgaccaccaaatacaaccaggctagaccctctgcccaagctccatgcttatatattcggtgcttcctggacacctccaagcagatgtcctttaagctcag

SEQ ID NO: 325813 - DNA, 1263 bp, Homo sapiens
ccttgagacctaatgccaaatagaaatttagatgtcttgtcggggctgattaacagaaaaagtaattatcaatcagttcacaggaaattatcattagctgtcttactgatactggttctctgtgagcgatcctctttataatttgtagagatgatttatttctaaaggaatggcaatgtgaataaaggtttctatatgttttagttgagaagagccctagagatcagctgtgtgtctcttgttttataattgtgaaaattgaggctcttggaaggcacatgatttgcccagggtcagtggccaagccaaggattagagagtgggctcttctctttttctgggtgaactttctactgcatttggacattccttgttttgtggattaacagaagtcagcatccggtattgtagctgtccctttcagcgaatggctccttggaagcaaacctgccagtggttatcaagctccttacatacccagcaccgacccccaggactggcttacccaaaagcagaccttggagaacagtcaggtctgttgctgcttttattgtttcctacagtagacacagcagtaggtggagttagttactaatcagtagtactatgtgtcattgttaactttttggttgcagtctggaaacatatttattaatagtctcttcatcatagaaagtttagaaaataaggaactctttatcatagaaaattttaaaaataaagaattttatattaaaaaagcccacaaacccataatctcaacacaaagagaaaaacactgtaacaataaaagtgaagtatttatatacttcagttttctatacatacatattttaaaagaaccattctgtaagtcctgtttcggtaggtagattttttttttcaccaggataacattaacatatttctctgtcatttaatttcttctgtaaagtatttagtagtatataattgattggctgtaatttaaattcaagtttttctggatataaaaaaggattccctaaacatccaggagccaattatttgtgtgcattcttgattagttccttaggagtacatttatagaaattgcattcctagattataattctgcttacgctttaagactttggatacatattgccaatttggcttcccaggaagttgccaacagtttatagtctcaccagcagaatattcagggtacctgcttccctgaaacctaagagtaatagtcatttaggttttttgctctgaatttgacacaaaatagcaattttg

SEQ ID NO: 325814 - DNA, 3487 bp, Homo sapiens
ctggagttgccgtgtgacgcgtgggcgggacgaggcccgggctcggggacctttcgcactcgggtcaggggtaaagcagcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325815 - DNA, 3355 bp, Homo sapiens
ctggagttgccgtgtgacgcgtgggcgggacgaggcccgggctcggggacctttcgcactcgggtcaggggtaaagcagcctgtcgcttgccgggcagctggtgagtcggtgacctggcctgtgaggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325816 - DNA, 279 bp, Homo sapiens
gcacgaggttcaaagaactctagctgaaaaggctccttacattgtttttgcccaccacctttatataatactcctaaatgatatctgtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325817 - DNA, 375 bp, Homo sapiens
gctgcggaagcctgagaatggcagtcgtgaaaccagtgagaagtttaagctcttattccagtcctataatgtgaatgattggcttgtcaagactggcttacccaaaagcagaccttggagaacagtcagacttcttccagagcctgcaatttcttcaataatgtcgggggaaacctaaagggcttagaaaactggctcctcaagagtgaaaaatcaattatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325818 - DNA, 3548 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325819 - DNA, 3491 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325820 - DNA, 3485 bp, Homo sapiens
cccttccctgttatattggctgatacgggggcgtatctatacatctatcaatttgataggcaaatcggcgaccgaatcgcgagagcgaggtctcctcgatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325821 - DNA, 3468 bp, Homo sapiens
atcgagcaatagtacgaggcggccggattaattcatcgagggtggtgtagtgcatgttctggtcgtcggcgacattctcaaatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325822 - DNA, 3416 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325823 - DNA, 3818 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccaaaaaaacaagcgggggggacaaaatcctcgaggggccgttagcctaccgttcttgtcccaggggccctaagagagcgacaaaaacaaaagagagcccgtaaacactcatcgtgcaactcctgggatctggaacacccacctgcccgtgcaatggcacacccacatagccgcacaaaacgtcttgtgaacgcatgccatgtgtacatccacacatcctcacctgcctccccgtcatcgtatctcgtcaccgtgttcatatccgattaccac

SEQ ID NO: 325824 - DNA, 3495 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325825 - DNA, 3319 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgttctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325826 - DNA, 3093 bp, Homo sapiens
ctgcactccagcctgggcggcagagctagactccgtctcaaaacaaaaaaaaaacccaaaaccaacctttaaaaaaaagacggaagaaagaacgtgtgaagtgaaaaaagtctcaagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325827 - DNA, 3931 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccatagttgttgcgtgttatttttaaaactatttgtcacaaagtgtggtgtggtaccacataacgtggtaacttttggttagtaatccagctgagaaacagcttgaacataaaaataacatcagtgtattttatgaaaaattagcaaacaataggtatattaacctccattttcagtcttttataaaaactattcacatctattaaaaaaaaacctatgggacttcagccaagattcagtgcctttctactggattcctcttactagatgcatccgaagaggccctagtttactttctccaatcatatagccaccaggtatttaatacagtaatatttatgtgtataacctgtagtgcaattatacatgattaacttcatatggtg

SEQ ID NO: 325828 - DNA, 3363 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325829 - DNA, 3871 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccaaaaaaaaaaaaaaaaaaaaaaaaaaaaaaaaaaaaaaaaaaaaaaaaaaaaaaaaaaaaaagggggggggcagaaaaaaaaatatctccccgggggggccgcaaaaaaagcaccccccgatttttggacacaaaaggggcgcaccaaaaggagggaggcagtaattaaaccaagaacacgaaggcggagggacagagagatcaaaaaagagaactagcggggggaaacacagcggcaactgcgggggcacaaggaggaagaagacacaccaccacaacagaggaggaggagagaacaacacagggggaaaaacacccccgaca

SEQ ID NO: 325830 - DNA, 3595 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattctttttttttatggctgttatgcttttaatggaagcagatacaaaattcatcaatgtaaaagaatgtcgacgcggccgcgaatttagtagtagtagta

SEQ ID NO: 325831 - DNA, 1934 bp, Homo sapiens
gcctgcccagctttcagcctctcgtggccttcaacatgactttctcgctaagtttaatcatttctggcttttgatttaaagaagagtgagagatggggactattccttttagttgaacacttagatgcaattgtagggttaataattggcctaatttcaatcttgttttgtctcagggaacagggaggcctgaggagagagaagagaaatagggaaaggctgtttggtgggcattcaggacatttattgatgaaaagtttaccatctttaatgggcatagttcatgacacaaatgcttaatttgtaaaaaatacaatgtaacaagggtatacctgtattgggaaatgagtcggagctttaaggcagggaaaatttgcttttattcttcattgaagtaacttatcatctgtgggtgtctctttacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325832 - DNA, 2214 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325833 - DNA, 1981 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaaggaagtattacttaattcacctctacaggaggaacataacttccccccagaccattatggcctccctgcagtttgtgatctctttgcctgtatgcagcttaaagttgataaagagaagtggttatatcgaactcctctacaggtgggtacatgccaccagcatgaaaattagattatagctatttataaaataaatgttttgtcttacatatgaa

SEQ ID NO: 325834 - DNA, 1034 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagaggatccaaagtgggaattccctcggaagaacttggttcttggaaaaactctaggagaaggcgaatttggaaaagtggtcaaggcaacggccttccatctgaaaggcagagcagggtac

SEQ ID NO: 325835 - DNA, 1509 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagccatagttgttgcgtgttatttttaaaactatttgtcacaaagtgtggtgtggtaccacataacgtggtaacttttggttagtaatccagctgagaaacagcttgaacataaaaataacatcagtgtattttatgaaaaattagcaaacaataggtatattaacctccattttcagtcttttataaaaactattcacatctattaaaaaaaaacctatgggacttcagccaagattcagtgcctttctactggattcctcttactagatgcatccgaagaggccctagtttactttctccaatcatatagccaccaggtatttaatacagtaatatttatgtgtataacctgtagtgcaattatacatgattaacttcatatggtg

SEQ ID NO: 325836 - DNA, 275 bp, Homo sapiens
gagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtgtgacatgtgcttttctcttctgttgtctggactcttgacacagggctgatttgagcatggccaaggacttggtctctccgtgccagcaaaaaatttcaccccatgccttgcgtggtc

SEQ ID NO: 325837 - DNA, 436 bp, Homo sapiens
taacgccagtaagggatttggacacatctggcttgacagcgtttcttgccagggacatgaacctgctgtctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325838 - DNA, 3494 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagtgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325839 - DNA, 3461 bp, Homo sapiens
  misc_feature (74)..(74): n is a, c, g, or t
ccgaatatcagagtgcggcggtgaattcatactggctggtgtgttcatgttcaggccgtcggctgtcatctcgnatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325840 - DNA, 3393 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325841 - DNA, 3507 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325842 - DNA, 3166 bp, Homo sapiens
ccttgagacctaatgccaaatagaaatttagatgtcttgtcggggctgattaacagaaaaagtaattatcaatcagttcacaggaaattatcattagctgtcttactgatactggttctctgtgagcgatcctctttataatttgtagagatgatttatttctaaaggaatggcaatgtgaataaaggtttctatatgttttagttgagaagagccctagagatcagctgtgtgtctcttgttttataattgtgaaaattgaggctcttggaaggcacatgatttgcccagggtcagtggccaagccaaggattagagagtgggctcttctctttttctgggtgaactttctactgcatttggacattccttgttttgtggattaacagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325843 - DNA, 2564 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325844 - DNA, 2142 bp, Homo sapiens
  misc_feature (28)..(28): n is a, c, g, or t
aactaaggctaggtacgaggctgggtgntgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaaggaagtattacttaattcacctctacaggaggaacataacttccccccagaccattatggcctccctgcagtttgtgatctctttgcctgtatgcagcttaaagttgataaagagaagtggttatatcgaactcctctacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccctccttcttacagaagtattttaattcaccccacactagaaatgcagcatctttgtggacgtctttttcacaagcctccaaggctccttagattgggtcgttactaaaagtacattaaaacactcttgtttatcgaagtatattgatgtattctaaagctagtaaacttccctaacgtttaattgccctacagatgcttctcttgctgtgggttttcttttgttagtggtctgaaataattattttcctgttctattaatacatagtgtattttgcacaaaaaaattaacctggtcaatagtgattaccaaaatatatattaataatcttggcaatttttgacattaattatgaaacattttagcccacgttagttctacattattcttcacttaaactcagctactgcaaattttgtctttctgtaaatgttattaaaatatccagtgagctctttagaaggactcagtattatttcaagactatttttgaggtaattctagccttttaaaatattctacagacctacggggcttaaaagaaccccagtaccgactaagcaaataggcaaaagacatgttggaaatgtagtatagtacttgaaacagtcactatcatagggataattggtgcatcctgtgtaaatggaagctgagcttgacacctggtgcttttaagtagggataaagtcatcctctcactgcaagcacagcatacctgtacctccaaaagtgacgttttagtgaacaggccgttttcaacacttgtgccttggggtgttcattgaagctttgtgaaaactactgatgttttctcagtctccttaaagttacgtccatgctttaaaatgtctgtgtaggagagaagtggggtttataatgttttctctaagatatctttgctgctttccagactttgaaactattaagcttcttaactgcctcttaccggaaatacttctggggaaacttcatggtcccaaaatgtcattgccatacagcttcactagagttctttgaaccacagctgaaaagagctttgtattattttttaattccctccccagatatcatttaggagtattatataaaggtggtgggcaaaaacaatgtaaggagcctttccagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325845 - DNA, 2113 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggaagtattacttaattcacctctacaggaggaacataacttccccccagaccattatggcctccctgcagtttgtgatctctttgcctgtatgcagcttaaagttgataaagagaagtggttatatcgaactcctctacaggtgggtacatgccaccagcatgaaaattagattatagctatttataaaataaatgttttgtcttacatatgaa

SEQ ID NO: 325846 - DNA, 1220 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcagacttcttccagagcctgcaatttcttcaataatgtcgggggaaacctaaagggcttagaaaactggctcctcaagagtgaaaaatcaagttatcaaaagtgtaacagccattccactactagttctttctccattgaaatggaaaagttatcttgagttgcagctctgtagtttcttgaggccaaacacactgtattttacaagtcaaaatataatttacattaatcactatgttaatgagtatgtaaaacattcttttgcattgatgaattttgtatctgcttccattaaaagcataacagcca

SEQ ID NO: 325847 - DNA, 1645 bp, Homo sapiens
agggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgctattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttcaattgtcttactcatcaactggagtgtacccaaaacaaagatctagccaatcaagtctctgtgtgcctggagagactgggcagtttgacccttaagcctgaagattcaactgtcctgctctttgaagctgacacaattactctgcgccagaccatcaccacatttgggtctctcaaaaccattcaaattcctgagcacttgatggctcatgctagttcagcaaatattgggcccttcctggagaagagaggctgtatctccatgccagagcagaagtcagcatccggtattgtagctgtccctttcagcgaatggctccttggaagcaaacctgccagtggttatcaagctccttacatacccagcaccgacccccaggactggcttacccaaaagcagaccttggagaacagtcaggtctgttgctgcttttattgtttcctacagtagacacagcagtaggtggagttagttactaatcagtagtactatgtgtcattgttaactttttggttgcagtctggaaacatatttattaatagtctcttcatcatagaaagtttagaaaataaggaactctttatcatagaaaattttaaaaataaagaattttatattaaaaaagcccacaaacccataatctcaacacaaagagaaaaacactgtaacaataaaagtgaagtatttatatacttcagttttctatacatacatattttaaaagaaccattctgtaagtcctgtttcggtaggtagattttttttttcaccaggataacattaacatatttctctgtcatttaatttcttctgtaaagtatttagtagtatataattgattggctgtaatttaaattcaagtttttctggatataaaaaaggattccctaaacatccaggagccaattatttgtgtgcattcttgattagttccttaggagtacatttatagaaattgcattcctagattataattctgcttacgctttaagactttggatacatattgccaatttggcttcccaggaagttgccaacagtttatagtctcaccagcagaatattcagggtacctgcttccctgaaacctaagagtaatagtcatttaggttttttgctctgaatttgacacaaaatagcaattttg

SEQ ID NO: 325848 - DNA, 6278 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325849 - DNA, 6040 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttattgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325850 - DNA, 6149 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325851 - DNA, 4804 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325852 - DNA, 1731 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325853 - DNA, 350 bp, Homo sapiens
gatccacacgacaggatgtctcgaatcccctgccccagtccctaagtgccagtaatacctcctagttactgccacacccaaacagcccctccatccatgcatattttggctgaaagccaacaacctgtgtcttgtaacacagcatgtggttctttttcttcccctgacagtattatgcctacctgtattcttatgtgatgccccaggccatccgggacatggtggatgaatacatcaactgtgaggacattgccatgaacttccttgtctcccacatcactcggaagccccccatcaaggtgaggtcccaccactggtggggctgtggatgcgtgcatgtttacttcact

SEQ ID NO: 325854 - DNA, 6309 bp, Homo sapiens
gggagaccgcgggacctggcgctgcagcgagattttcaaacaccgcattccccttaaacctcccaggctcccatcactcccagcaaagagccagcccgctactttatggagacaggagagactgtcagacagttcctgctgctgcccaggtgcatctgagagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325855 - DNA, 6122 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccaactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtggtccgtactgagaagaacagtttgaacaaccgattcttaccctggaatgaaattgagacagaggccatcctgtccattgatgacgatgctcacctccgccatgacgaaatcatgtttgggttccgggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaagtattatgcctacctgtattcttatgtgatgccccaggccatccgggacatggtggatgaatacatcaactgtgaggacattgccatgaacttccttgtctcccacatcactcggaagccccccatcaaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325856 - DNA, 2832 bp, Homo sapiens
cggcagggggagcggcggatcaggcgcggcctggaaggcgggcggccggcagccagaacggcttctgggacgccgactttcgcgcaggcggcggcggcggcggcggcgggtccctgagctggaagccggagagcaagccctggaggttcactctttcaagaagtcgtgtgctgaggtgtaatgctacacaagtcagaggaaggaagggtcctgaaacacatggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaa

SEQ ID NO: 325857 - DNA, 454 bp, Homo sapiens
atctgcgcctggcacagctcctggctctcaaggccagctctgtaataactagatattgcatctgctctctaccctttgtgtggagtaatgattcttggctcccacagctgttccggagacttcaaggcactagctcgatggtctgaaaaacagagatgagctccttgaacttggatcattggttgagggggctagagggagaatgggaaccaccccctcagtcccctgcactgactcactccccgacatatccggacctccccaagtccagaaggaaggaatggagctgagcaactgacgtcaaatccccaagtcgactcaagaggctgccaggaagcagagatgcagaccccaaggagactgggctggggctggtatcacaccctcactctatatttatgggaggaaaagtgaagattaaattcccaagttgtgcgtgtgactaaaaaaaaaa

SEQ ID NO: 325858 - DNA, 886 bp, Homo sapiens
gcacctgcgtggtgtgcgggggtggagcgggggctggagggagagttaatgatttgccacaggctcatttcgcaacttaaccaagggtcagcttcccgtgaccatgtaccagctgcgtcctctgggccacgctccacttgcccgcttccacccggaaagccccccaggctgagtgcggcatgatctccatcaccgaatggcagaagattggtgtggggatcaccggtttcggcatcttcttcatcctctttggaacactcctgtactttgattccgtgctcctggcctttggaaacctgctgttcctgacgggcctgtccctcatcattggcctgaggaagaccttttggttcttcttccaacggcacaaactcaagggaaccagcttcctcctggggggtgtggttatcgtgctcctacgctggcccctcctcggcatgttcctggaaacctacggattcttcagcctctttaagggctttttccctgtcgccttcggcttcctgggcaatgtctgcaacatccccttcctgggtgcgctgttccggagacttcaaggcactagctcgatggtctgaaaaacagagatgagctccttgaacttggatcattggttgagggggctagagggagaatgggaaccaccccctcagtcccctgcactgactcactccccgacatatccggacctccccaagtccagaaggaaggaatggagctgagcaactgacgtcaaatccccaagtcgactcaagaggctgccaggaagcagagatgcagaccccaaggagactgggctggggctggtatcacaccctcactctatatttatgggaggaaaagtgaagattaaattcccaagttgtgcgtgtgactaaaaaaaaaa

SEQ ID NO: 325859 - DNA, 218 bp, Homo sapiens
gcatttctacccaaatttcatgacccaacagtttggaaaaaatgaacattattcctggcagaaaaaaattatctgtttttgtcacatcacatgcagagccatctgagaacaaatgtctaagcaaaaaaagaaacaatactggaatttgataaagactcctcaggaatatggcatttagctgtttcttttcttttcttttttgagatagagtcttgctc

SEQ ID NO: 325860 - DNA, 747 bp, Homo sapiens
ttaccagatcagccctacaagatatggtaaaaggagttctaaatcttcaaacaaaaagttgatatgcaccagaatagaacctcttgaaagcatgcaacttacaggactgccaggcacggtggctcacacctgtaatcccagcactttgggaggctgtggtgggcggataatgaggtcaggagttcaagaccagtctgaccaacatggtgaaaccccatctctactaaaaatacaaaaattagccagacatggtggtgggcacctgtaatcccagctactcaggaggctgaggcaggagaattgcttaaacccaggaggtggaggttgcagttagccaagattgcaccactgtactccagcctgggcaacagagcgagactctgcctgccatccccccaccccccctccaaaaaaaaactcacaggacctataaagcaatagcgcagtaaagaaaacaaagtactaggtaacaatcaacatgatgactggaatagtaccttatatctcaatattaatgttgaatgtaaatggtctaagtgctcacttgaaagaagaagattggcagaatggataaaaattcacaaaccaaatatctgctgtcttcaagagattcatctaacacataaggattcctatagactcaacgtaaaagagtggaaaaagatatttcacacaaatggaaactcaaagtgagcaggagtagctattgttatgtcagagaaaacagattttaaagcaacaacagtt

SEQ ID NO: 325861 - DNA, 1909 bp, Homo sapiens
agcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgta

SEQ ID NO: 325862 - DNA, 2088 bp, Homo sapiens
agcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325863 - DNA, 786 bp, Homo sapiens
  misc_feature (668)..(668): n is a, c, g, or t
  misc_feature (670)..(670): n is a, c, g, or t
agcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctantntgtatgggcaattggtcacaaacattgttcactgcagaataggttcccacacaggaaagattggccactggttccgcgagttcgcactaagacatgttgctgccctaattagggac

SEQ ID NO: 325864 - DNA, 1050 bp, Homo sapiens
cgagattccgggattggaatcaaaatgctaatttaaaaggtcaagtgaagctgctcctcacgttttggcgtgcctgcgctctctgcaggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggtaagaaggattcctgagtcctgtcttagcgaaggtccgctttgtcttttccatgcttgaactttcacagctgtacttggagtgttactgagtgaaagccaaaagtgcttttttaaaactaggagaccaaacaaaagtagtttacatatacactgtattcatgaagaataaaaatattatgctcttctgttt

SEQ ID NO: 325865 - DNA, 1008 bp, Homo sapiens
agcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcaggtatgatttaggttattttaagatatacatgaacaatattaagagttgtctggatgatacagaaactatccttgctctcaaggacaattactatgtttgaaagctctaaagtcgtattatgcagtagcattttttctcatttagcatgacatggtatatgtaaaccttaacagtgaaattttgacacgctgacaaagacaaatatgagacattttataaaatgcttatgtttatagagtgccttctaagtaatactttctctgcaaatggttttcaaatgttactgtaaacctcacaacactgcaaaatagttattttcattttagggctgagggagcaggctcagagaggttttcggtatcattgatactattctccctttgacatggatttattagatatttaaatcatgttaattgcataaatgatagctctttccttttgtccaaattgggggataaaacttgttttgatttagaaagacttctgttttgttcttgtttttgtgacgtaatcttggtttgttgcccaggctggagtgcagtggtgcagttgagctcactgcagcctccgcctcccagggttcaagcaattctcctgcctaagcttcctgagtacctgagactacaggca

SEQ ID NO: 325866 - DNA, 2032 bp, Homo sapiens
cgagaagaaatttcacccagagagatatcgtcgaaccacgctgtccgggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325867 - DNA, 2192 bp, Homo sapiens
tccccgtttattcatctttggttcgtatttctcgatcttacaagttcgtaggtttgagaaagaacaggaaaaggtgacttctcacaaataacagtgctggagatgacaacttattgaactcttaagttctcagcactatgttatgcacttgacgggcattactttaatcctccactgtgagatacttgttattgcctcattttgtagacgagaaaacgggcatagagggtgagacattggcccaggttcattccgtaaggttggagcctggaattcagatacaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325868 - DNA, 1029 bp, Homo sapiens
agcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggtaagaaggattcctgagtcctgtcttagcgaaggtccgctttgtcttttccatgcttgaactttcacagctgtacttggagtgttactgagtgaaagccaaaagtgcttttttaaaactaggagaccaaacaaaagtagtttacatatacactgtattcatgaagaataaaaatattatgctcttctgttt

SEQ ID NO: 325869 - DNA, 1472 bp, Homo sapiens
aaacccgaaggtctcgccccacacccgtcgctattatgaggataattttccggaatcccagggtcttaatgggtggttatgtctttaaagaggccccctacgtgggattggaagggtttctttggaggaaaacccggaacactggatagatctttaatataccgaccccgataacttggccccaaatagagattctaccttgggaactagaaaataccctttttttttttttttgaaacaaggttttgctctgtcacctgggctggagtggagttcagtgcagtggcatgattatggctcagtgctgcatcaaactcctgggctcaagtgattcctcccgcttcagctcctgagtagctggtattacagatgcccagctgatttttaaattttttgtgttggggataacatgtatgttatcccgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325870 - DNA, 731 bp, Homo sapiens
tatctatactgacgctatctatactacgtatctatactgacttatctatactgacctatctatactaccagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325871 - DNA, 1930 bp, Homo sapiens
cgagattccgggattggaatcaaaatgctaatttaaaaggtcaagtgaagctgctcctcacgttttggcgtgcctgcgctctctgcaggcagaagcgaacaaagacccagcaagagaaggcagaggctaagacccatcccgtatctgctctcctgaaataattctggagtcatgcctgaaatgccagaggacatggagcaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgta

SEQ ID NO: 325872 - DNA, 884 bp, Homo sapiens
gagtttttcgccgggactgatcagcgtggttgccctccagctccccgcgttgttgtttctcgtcggcccttcaattcttcgggtgttggttgtgccgccgattgctcgccgcccgcgggatgtgggttttttcttccaggcgatgtgccgtgctgagcgctggttttctccgctgcgcgcgccgttgtttttaatcgggcgccggcctgttctgtcgtcgttattattattcgctgcccttccttatgggggccccctcttgttgaccagaggaggggggtgggtggctatatattggtggtccccccccgtattttccccccccccccttttttttttttttttttttttttttttttttttttttttttttttttttttttttttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325873 - DNA, 2361 bp, Homo sapiens
agcggggtcgttctgggcctaggggaggcgggccgagggcgtctgagctgaggcccgcgtcgatcctgggttggaggaggtggcggccgctgaggctgcggcgtgaagacggcgggcatggtggggcgggagaaagagctctctatacactttgttcccgggagctgtcggctggtggaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcagccccatgttatagtacattgtgcagcagagagaagaccagatgttgtagaaaatcagccagatgctgcctctcaacttaatgtggatgcttctgggaatttagcaaaggaagcagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggagctgctgttttgaggattcctattctgtatggggaagttgaaaagctcgaagaaagtgctgtgactgttatgtttgataaagtgcagttcagcaacaagtcagcaaacatggatcactggcagcagaggttccccacacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttgaaaaaaaacaaaacaagataacgcccaaaaagcagagcaaaacaaaacggagggggaatagaactaaacacagagacgaccagcgacacatgagaagcggggacgcacaccaaaaggagcaggaaagcgaattatttagaagaagaaagcatatggaggagagtgacaaaaaggaggggggaaagataggaagattaaaagacacaacagagcacggcagacgaggaaaagtagcgcacaccaccgagggcgaaagggcagccagcacaccagt

SEQ ID NO: 325874 - DNA, 1335 bp, Homo sapiens
ggaccgcgtgggtcgacccacgcgtacgcacatgtcaaagatgtggccactgtgtgccggcagctagcagagaagagaatgctggatccatcaattaagggaacctttcactggtctggcaatgaacagatgactaagtatgaaatggcatgtgcaattgcagatgccttcaacctccccagcagtcacttaagacctattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttga

SEQ ID NO: 325875 - DNA, 412 bp, Homo sapiens
gtttaatgagatacaagacatacttccaggatagagcgcagacagcactcttgacacatatagattgaagggaagaatgctgcatttggccaatctaaggtggcttcctggaggaggcatagaaccatggttgaaaggaggaagaagaatccccagatgagtgcctggaagagcttggagagctcagggctaatggttcagaaactggaattaaactatgaagagattagatacagtttgggattgtggtgcttggaatgctgctcgattgacagggagccactgctgatgggaagggtaggaacaggggatgctggtgacataaccagtggagaagctgaggagcccctcttcactggtacatccttccctttacagtggctggatctctgctctggtggtgccgaagggc

SEQ ID NO: 325876 - DNA, 463 bp, Homo sapiens
gctggaatgggcggtaatgtctttgtcctctacttgcagatccactccttataccgccgcacaggtgccagctttcagaaggcccagcaagaatttgctgctggtgtcttctccaaccctgcggtgcgaacccgagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaag

SEQ ID NO: 325877 - DNA, 473 bp, Homo sapiens
gctggaatgggcggtaatgtctttgtcctctacttgcagatccactccttataccgccgcacaggtgccagctttcagaaggcccagcaagaatttgctgctggtgtcttctccaaccctgcggtgcgacaccgctgttgcatatgtcccgttggagtttaatatgcactaagtcatttgcagtgcttggagttgtggacacggccttgagtctcggtgcgagtgtgcgtgagtgtgagccaccttgccaagtgcctgcgcagggcccggccgccctccatctgggccgggtgactgggcgccggctgtgtcccgaggcctcaccctgccctcgcctagtctggaagctccgaccgacatcacggagcagccttcaagcattccattacgccccatctcgctctggcgctctccccaccagggcttcagcaggagccctggactcatcatcaataaacactgttacagcaaat

SEQ ID NO: 325878 - DNA, 217 bp, Homo sapiens
ctgaaaaagagggtgttctctcttgcttggacagaattgaaacacttctgcccaaagaacagattcaaaattgggccttgccgtctcatcagtccttgaaagatttctgctgtggaggatctgttgtttttcagtttttctgttctgagaatggaggtgagagagcagctttggcgctctccacgccaaagctgtctctcactccattctcagaaca

SEQ ID NO: 325879 - DNA, 429 bp, Homo sapiens
  misc_feature (156)..(156): n is a, c, g, or t
ggcgtcacgccgacgtcaagtcgaggccgccgccgcggggcctggttatcgccggttcagcgcagcccggagtcgcccaggcctgaactcctacccaggtccccggcccccgccccgggcccgcgaggacaccggaggccaccccccgggggtggnggagcggagccgcggcctagactcaagtctgggtttcagctgccgccagccctattgctgctgttgctgttctctgtccttggcccaggggctgggtctccaggatgagtgtcagtacctccttcagccgcagctgattgtccggcgtttgctggacgtcgctgtgctggttcctggccggccctcagagcaaaccctctccccacacaatcgctcagccctgtacaagtaagtcaaagactccccacacctggtcctttccctcttctgtgg

SEQ ID NO: 325880 - DNA, 2006 bp, Homo sapiens
catggaagttgtgacagctcccagcggcgcgcccctttcgtgtgtgccggtacctcggcttaggagtgcccgctgacaccttgaatgaaggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcaaaaaaaaaaa

SEQ ID NO: 325881 - DNA, 3040 bp, Homo sapiens
ggcgtcacgccgacgtcaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaaaagttct

SEQ ID NO: 325882 - DNA, 1941 bp, Homo sapiens
  misc_feature (514)..(514): n is a, c, g, or t
  misc_feature (660)..(660): n is a, c, g, or t
gggactggccagccagaggaagagggcatgaggacacagccagcagcagttactgggtcgtgatgacgcagacctgccgggacacccccgtgggctcgaggcattggatgggcctgagagctgaagcaggggcacttgcaggaatggcacttgaagccacctgcctggctttacagggcagcctcctggaagcctccatgaaacgcagctttccctgggccacacactgcctggctccacaaaggcgaacaacacagcctgctttgccccggatattcctggttttggcattaaatgtccacagcctgagaaatccttcagtctcgggcaaatgggacgtttggtgaccctaccaccatgtatctttgattttagactcccctgaccaatgggagggctgcaagcactggctgggcctggcggaggtggtctttggtcatctctgtggtggctgaagtcccattagcctggcagggccccctctcttaccaccagaaatggatcctttcccaangctgctccccatcacaagcccttcctttcatcccattcctgccggttcagcgcagcccggagtcgcccaggcctgaactcctacccaggtccccggcccccgccccgggcccgcgaggacaccggaggccaccccccgggggtggnggagcggagccgcggcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcaaaaaaaaaaa

SEQ ID NO: 325883 - DNA, 1419 bp, Homo sapiens
ggcgtcacgccgacgtcaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcggtactctttatggagagtggggaggttgctctgccagggagcttgaaggggaaggtgtcaggggtgttggggtgtttacctcctccaggaagcctgtccaggttgctcccaccca

SEQ ID NO: 325884 - DNA, 2670 bp, Homo sapiens
  misc_feature (514)..(514): n is a, c, g, or t
  misc_feature (660)..(660): n is a, c, g, or t
gggactggccagccagaggaagagggcatgaggacacagccagcagcagttactgggtcgtgatgacgcagacctgccgggacacccccgtgggctcgaggcattggatgggcctgagagctgaagcaggggcacttgcaggaatggcacttgaagccacctgcctggctttacagggcagcctcctggaagcctccatgaaacgcagctttccctgggccacacactgcctggctccacaaaggcgaacaacacagcctgctttgccccggatattcctggttttggcattaaatgtccacagcctgagaaatccttcagtctcgggcaaatgggacgtttggtgaccctaccaccatgtatctttgattttagactcccctgaccaatgggagggctgcaagcactggctgggcctggcggaggtggtctttggtcatctctgtggtggctgaagtcccattagcctggcagggccccctctcttaccaccagaaatggatcctttcccaangctgctccccatcacaagcccttcctttcatcccattcctgccggttcagcgcagcccggagtcgcccaggcctgaactcctacccaggtccccggcccccgccccgggcccgcgaggacaccggaggccaccccccgggggtggnggagcggagccgcggcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcaaaaaaaaaaa

SEQ ID NO: 325885 - DNA, 2093 bp, Homo sapiens
ggcgtcacgccgacgtcaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcaaaaaaaaaaa

SEQ ID NO: 325886 - DNA, 2717 bp, Homo sapiens
ggcgtcacgccgacgtcaagtcgaggccgccgccgcggggcctggttatcgccggttcagcgcagcccggagtcgcccaggcctgaactcctacccaggctctctggcacaccagccttgtgtcagggtgggcagcagcacaagggtggctggggcggggcatggctaaaggccagcaggtcacccagtgggtcagaggccatgatctggaggaggcaacttggcagccccaggaggacatgctgggtccagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcagttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaaaagttct

SEQ ID NO: 325887 - DNA, 1090 bp, Homo sapiens
ctgaaaaagagggtgttctctcttgcttggacagaattgaaacacttctgcccaaagaacagattcaaaattgggccttgccgtctcatcagtccttgaaagatttctgctgtggaggatctgttgtttttcagtttttctgttctgagaatggaggtgagagagcagctttggcgtggagagcgccgggaggaatgggctgtccttggaaggtgtgggttaacaggggtgggagtctgagggtggcggtgggtggagatggaggatgtggcggcctcacttccatacctgccctccccagagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcaaaaaaaaaaa

SEQ ID NO: 325888 - DNA, 199 bp, Homo sapiens
ttttcaaacagctttattgagatataactcacatactgtactatctatccatttaaaatgtgtaatttaatggtttttagtatgttcacagagttgtgcaaccgtgctcaccacaaccaattttagaacatttttatcaccccataaagaaagcctgtgcatcctcctccagttcctccacaccccccaaccctaggga

SEQ ID NO: 325889 - DNA, 415 bp, Homo sapiens
cttcctggggagacagctggtactgagaagaagaggaaataagattatatctataaatacaaattcagattataggattacttttaaaagtcagatactagactttaggccagggaatacaaaattcctgttttatcaccacacaggtgacaacagagggaagtaggcttcctatatgacaatagggagcagtgggactgtgtttaaataaagagaacattcaccacccaaagtggggagacactattcagctctagtctcttgctgatatttggaaacacagacccaggctaccatatcctccaattctttaaaagtaattggaaagtcaagagtttttatgaaagttaaagaaagaggacattaacaatgaaggaaggtttatgagcaagcagggaggaatgaaatccaaaca

SEQ ID NO: 325890 - DNA, 420 bp, Homo sapiens
gcctcctaggcctaggtgtctgccctagctggagaaaggcacaagaagaaaacaccagtcaatgggagaaaagtcccccaggccagtcttccacctagagcccctcccctttctcaccacaaagattgcttcactgagggcggggcgcagtggctcacgcctgtaatcttaacactttgggaggccaagacaggcgatcacttgaggtcaggagttcaagaccatcctgaccaacatggcaaaaccccgccttcattaaaaatgcaaaaattagccaggcatgatggtacacacctgtagtcccagctattggggaggctgaagcaggagaatcgcttgaacccaggaggtggaggttgcagtgagtcgagatcgcgccactgcactccagcctgggtgacagaatgagactctgtctca

SEQ ID NO: 325891 - DNA, 277 bp, Homo sapiens
aggggaattttgccatatatttgctatccctggactgcagagacacagattagaattttggaatagctgtgatagcaggtaatcaggaactatattccttcagtcatatataaggacttgctgtaagcactgtggaaatgtatataaaatatactgctaagatagaatttactagatatggacactgattcatttactcggcaaaaatatgtggtggccaaaaagaagccagggataagagaataaaatgtaaactctgctctcaaggaactcacag

SEQ ID NO: 325892 - DNA, 150 bp, Homo sapiens
attcttccgggcctcactctatttattgatcatcctcctggtcattagcagctagtttttcactctactggtgcctttcccctgtcttagaaacactttccctcaactcatttttctaccctttcaaatgatcactcttctctttatttt

SEQ ID NO: 325893 - DNA, 190 bp, Homo sapiens
atctgcaagtcacacccttctatagaagtaaaactgccttgctgagaaaattaaatttatgttcgagtgctatttataacaattccatcataaatcaaggagcacctgtatatttgtacatatgtgtgtatacatatataatgatgaaaatttagtatagttacctttctgaatcatttttatagctgtg

SEQ ID NO: 325894 - DNA, 2599 bp, Homo sapiens
  misc_feature (452)..(452): n is a, c, g, or t
  misc_feature (1541)..(1541): n is a, c, g, or t
  misc_feature (1778)..(1778): n is a, c, g, or t
cagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtatcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcnaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgagtgcagccccacccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctatnatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatntcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcgtccacaggcagttccgaagcaagtttccctactctctcacccctgtaaacacccccacaggtacaggtacagcaggacaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaag

SEQ ID NO: 325895 - DNA, 2167 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaactcgtgccgctcgtgccgaattcctgcag

SEQ ID NO: 325896 - DNA, 2415 bp, Homo sapiens
  misc_feature (452)..(452): n is a, c, g, or t
  misc_feature (1357)..(1357): n is a, c, g, or t
  misc_feature (1594)..(1594): n is a, c, g, or t
cagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtatcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcnaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctatnatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatntcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcgtccacaggcagttccgaagcaagtttccctactctctcacccctgtaaacacccccacaggtacaggtacagcaggacaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaag

SEQ ID NO: 325897 - DNA, 398 bp, Homo sapiens
  misc_feature (36)..(36): n is a, c, g, or t
tagtggactcagtaccatattccctgctcccgctgnccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtcagaggtccctgaggggctggatgtgaaaaggaggctgggtgccagggatctcaagtgggagcagggaatatgg

SEQ ID NO: 325898 - DNA, 2039 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325899 - DNA, 2264 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctagtgaagcgcttgcagacgcactgctacaaggtccatgaccgcaatgccaccgtagataagttggaggacttcatcaacaacattaaacagtgtcttggagtccttgtatattgaggtaatcgtgaggg

SEQ ID NO: 325900 - DNA, 2237 bp, Homo sapiens
  misc_feature (452)..(452): n is a, c, g, or t
cagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtatcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcnaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgagtgcagccccacccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325901 - DNA, 1416 bp, Homo sapiens
ggcgccagataactactcctcagaggaagtgtattataaccatgcgctctgaatggaagtcatgtccatggcactgtgcctcatccgctgtcacccttgaccacaactccacttagtacccacgttggccccatcatgatgtctctgaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325902 - DNA, 1227 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcaggtaatggcgggggctgagaaggcagcaagaaggggaagaggtgatgagggtacaaggtggagcagacaggaagagagtatgcaggctgactccacactcattcattcattcaactgatgatttactgaacatgccacgtaccaggcactgtcctaggcactgggcgtacagcagtgagcaaaacacagtacctcatttcctggagttcacatgcccatggagcaaga

SEQ ID NO: 325903 - DNA, 2682 bp, Homo sapiens
  misc_feature (1624)..(1624): n is a, c, g, or t
  misc_feature (1861)..(1861): n is a, c, g, or t
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgagtgcagccccacccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctatnatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatntcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcgtccacaggcagttccgaagcaagtttccctactctctcacccctgtaaacacccccacaggtacaggtacagcaggacaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaag

SEQ ID NO: 325904 - DNA, 457 bp, Homo sapiens
tgagcaggagggcacccacaccacccccaaacatgcccatccatgatacagtctctcctggctgccaagaggtcctcaagtccaacttagttccccttctctataacccaagggaagtttctctcattctgcctttaggagctgcattgtgtctagaaggaaaaaagctgctcccttttctctgtctgggttgcccagggatctggaaagctcttccttctcctcctcccctctgcccttcttggggctgtgatcaccctcctgtctgctgtcctggcaggaaccatgctgatgctggccgttctgctgccactggccttctttctgctccttgccaccgtcttctcctgcatctggaagagccacccttctctctgcaggaaactgggtaggaaagggttggatgcagtggatggttggcaatgggagccggagggaggaatattcaacttccccg

SEQ ID NO: 325905 - DNA, 2136 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325906 - DNA, 1871 bp, Homo sapiens
ggagggccactggcaggatgatggggggccagagagaccgagggaaaggccagggtcacactacaggcagcggaggtgagggtggagcctcgtctcctgaggctctactgctccactcacgttctaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325907 - DNA, 2221 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaaaaaacaacacaaaaccaacacgaagaacgagagcaccaacaacacaaacaaacagaaaagccacaacaaaaacaactaaacgg

SEQ ID NO: 325908 - DNA, 2053 bp, Homo sapiens
  misc_feature (452)..(452): n is a, c, g, or t
cagatccttggcttaaaattcctcttctcattccatgcagaggctcacagaagggttctggagggacatggaactgggacaggtgcaggggacacaggaggtggttcttctcagtactgggaagcttgggcaaaatggtaggcagtaggccgggtgtggtggcccacgcctgtaatcccagcactttgggaggccgaggtgggcggatcacgaggtcaggagatcgagaccatcctggctaacacagtgaaaccccgtctctactaaaaatacaaaaaattagccgggcgtggtggtgggcgcctgtatcccagctactcgggaggctgaggcaggagaatggcgtgaacttgggaggcggagcttgcagtgagccgagatcgcgccactgcactccagcctgggcgacagagcaagactccgtctcaaaaaaaaaaaaaaaaaaggcagcnaagcagagcttgggaaaggtgagagctacgcaatggggtggatgggcatcctgaggcttaaaggaaactcacaggccggcaaagggcccctcccttttgcccattcaccctggctggcctgcctttctcttgccagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcaccttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325909 - DNA, 1729 bp, Homo sapiens
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggaccta

SEQ ID NO: 325910 - DNA, 2498 bp, Homo sapiens
  misc_feature (1440)..(1440): n is a, c, g, or t
  misc_feature (1677)..(1677): n is a, c, g, or t
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctatnatcatcctcatggactgaaggaagaaaccgaggctcaaagaggttaagtgatatactcaagatcacccacacaggtggtcactggtgttattagaacctgtactcaggttttcttactccagagcccatgtcataatgcatgcactatagaaaattagagacttcagataagcaaaactaaaaactcacccacagagccactacctagaatatccactcgttacattgtggtatatntcctcccggacattttctatgcatgtttatacatactgggttttgttgttgtttactaaaagtgaagtaattttaatatttcgtaacctgattttttcattccacaatctaagtatttttctgtgccctgttaatttttaactatgtatcaaatacaactggcattttagagctggaattttagagagtatgtaagctaacctcatcctatatatgaaaaactgatgcccaaagaagtgaaatgacttaaaagtcacacagccgggcaggaaaccgtggcccagactcccagtccagtttctccccaggcctcccatcccatattcccttaggctacagatttacatgaatgagaagaggcaaaatgcccagcatagaaatgcgggagtcctcccgcccttccccaggcgtagctgacggacactggaggctccatgctattgctggcagcactggtacccagagaaagagaaattacccactgctacagatcacagctggagaagccgaactccagcctctctttctcttcccctcctagaacctgccctgagcaagggggtggagaacttgcaagccctgctctaccaggcgtccacaggcagttccgaagcaagtttccctactctctcacccctgtaaacacccccacaggtacaggtacagcaggacaaccctagctcctctacagcagcccctctgtacaatggctgaggccacagaaatgtggctctagcctgtgtctgtttacaactccaagtcccacccttccctactgtctcccaatcccacttccagaccttgaaaatcaactgcctaag

SEQ ID NO: 325911 - DNA, 515 bp, Homo sapiens
  misc_feature (395)..(395): n is a, c, g, or t
  misc_feature (494)..(494): n is a, c, g, or t
  misc_feature (510)..(510): n is a, c, g, or t
ccactcccacttcctgagctccgccgtgggagccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccagggnttgaatgcagtcgggaaggggaggacgggaagtctagccggcttggacccgccccactctgttacctgccagatgacgctgaggaaactgcttttcttntcgacgcctccgttgncccgt

SEQ ID NO: 325912 - DNA, 4352 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctcttgaggttgctcattgcccttggacctgtgaggaggccttcagattagtaattggtgcttagtactatttatgcttaaatagatcttccagtacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtggttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtgagggatgac

SEQ ID NO: 325913 - DNA, 481 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgccacgccgtcgagaatgacaatttccaggatgacctctacgcgggactccctcagcttcgcaagagactgcctcagcttgatgacgatgcggacactgcaacacacacctccaatcctcctcgttggctcactacacccattacacc

SEQ ID NO: 325914 - DNA, 2924 bp, Homo sapiens
actgcacatgcgcccctctcaagtgctggcagaccactgtgcatgcagacaacgcacccaaagggaagaatcaggggaacagtaacgcaaccctgccagcatgccaatgtagaaaacttgaaagaatgaacacaaaaatgtttacaaaggatatcatggcagagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325915 - DNA, 2988 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaagaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325916 - DNA, 2533 bp, Homo sapiens
aactatacagagaagtcgcagtcatgttgaactcgatcatatgactatctgtaccacccctgttgtttaccaccttggcaattcgtctagaagtatacctggaatcttaccagtttggatatggtcgtcgttctcataggacatgactgagatttgcctgccgggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325917 - DNA, 2039 bp, Homo sapiens
  misc_feature (19)..(19): n is a, c, g, or t
  misc_feature (55)..(55): n is a, c, g, or t
tgcgagggcgcggggaggntgggtgtggggggcgcggtgcagagggagagggggncattcctgtacatcttactgggtttaattaaaaaaaaagaaaaaactctgttaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325918 - DNA, 2724 bp, Homo sapiens
  misc_feature (2678)..(2678): n is a, c, g, or t
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatgtgtattttaaacacagcagttgactgagtnattttctatagtaccctgaggtgtttaaaatacacattttaaatcc

SEQ ID NO: 325919 - DNA, 1372 bp, Homo sapiens
tgaactgcagttgtgtctatttctttgtgtgaaatggaagggagtaacatggtcacatataggtcatactgtacaaactggtattttatactgttccaatgccagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325920 - DNA, 1437 bp, Homo sapiens
  misc_feature (1153)..(1153): n is a, c, g, or t
  misc_feature (1177)..(1178): n is a, c, g, or t
  misc_feature (1231)..(1231): n is a, c, g, or t
  misc_feature (1260)..(1260): n is a, c, g, or t
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttactgcntatgctctgcattactgggtatannaaagaaacttgtgaaacagtaccatctactgtacactgtgatagtataagagnagatatttctgtgattaactttcctgctngagtgacattgtacgctgctgtagatctctgagtgtatcgatggatacttcacacgaatttgccaatgtgaattggaggtcattttgaaaagggggttaatttcccaaaaaattttcaggaattcttctttaaaaaagggccctgttaaaatcggaaaggtgtttaaaaagaaccgg

SEQ ID NO: 325921 - DNA, 608 bp, Homo sapiens
agatcattagtaacttacttgatcagttaacagggaaggggactttaaggggagaagagactatagtgatgtttaacttaaatttataaagatttttttgtttgacaattttcagattaatacttattggattttttttaaattatacttttaagttctagtggatattaagtgaaatattggagttgtggtataaatggtttcttatatttctgtggatagcacatgagaatgtgtaagcatcattcatccaagagaatttgtgtatttgatcagtttgtgaaatgcagttttattttgacttactgtaaccaacatttgtttgtattcagtgtccttttctacctttaaaggatatcagtcatccgtttgaattacttgtatatgctttccttctgaagtaacagagatttctttgtttttatgccaccatggcaactgcaccatacaactactcttacatctttaaatatattattattggtaagtttatttaacttacactcttgttcccaaaagaaggttaacatacaaaatatttatatgttaatacttaaacagtaccacttcaggactgagtgattttcttactgtaaaactaaaactcc

SEQ ID NO: 325922 - DNA, 3190 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325923 - DNA, 994 bp, Homo sapiens
  misc_feature (943)..(943): n is a, c, g, or t
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcctgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagagtccaggcgacgcgggagcggcagcggaaaggggggaggctgggcggcggcggcgttggcgcttctgacggggggcggggaaatgctgctgaacgtggcgctggtggctctggtgctgctgggggcctaccggctgtngggtgcgctgggggcggcggggtctgggggccggggcggggcgggcgagga

SEQ ID NO: 325924 - DNA, 3144 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325925 - DNA, 3131 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccaggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325926 - DNA, 3136 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325927 - DNA, 3140 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325928 - DNA, 2559 bp, Homo sapiens
ggatatgttgattaaatatgtattttaaatatttaagttttttttctataattatatggcagtcacaaatttaaacttttatttttgcagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaa

SEQ ID NO: 325929 - DNA, 2773 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcaga

SEQ ID NO: 325930 - DNA, 2500 bp, Homo sapiens
ggcgcgagcgcccgtggggcgggcctcagcggcggcgcgacaagtccagaggtgagggctgaggaaggggcgtggctagcgggctggcctcagccaccctcttccgggctccgccagctgcgcgcgcatcttctcccccttcttttgtggtccggcccattgcgagggtgacaggaaaccctgtgcagggagcgccgccatcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtgggtatttcccacttggaataaaaactggtttagcagggagatttcttggtggaatatttg

SEQ ID NO: 325931 - DNA, 5746 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325932 - DNA, 701 bp, Homo sapiens
ctttactcaaaattaaggtgtctaaaatatacatggtataaaccactcaatacagtaaatgactgaactccaccaactgccatatactcataaaaacacgagagatttgagggtttataatttattttctatcaaaatcactttaacatattaggaactacttctttctttgcatgttagaggaaaactcttgagaaaagtaagctatgctacaaaaactaaattagagactaatgcagaaaatatgctccaggaaaacagagacttttgtctatactctatttccacaaaatagaacagtgcctggaaataccaggagttcaataatgtctttgaagaatgattacacgtgcagccaagaaacctgtgtaacttacatggcagtcatagaagtgaatttgacagaattactgtaagggctattttgggaattatttaggaaatagctcacggacagcttattgcttcatctttacttactttttgaactgaagtgaaatgagacccttgaattgttgacatagaattttgaaaacagataagtacaattcagcatatttaaataactacaatggcagacttacatataaacaacttgggtttcgtttttctaaagttgtgaaaattacaaaaaagggaaacatacctcacataaatgtttcttgttaccattctggacatatgaatcacatatttagagc

SEQ ID NO: 325933 - DNA, 445 bp, Homo sapiens
aatgccatgcatgtcagaagggggacctagtttagtctcaggatttaccaagccaggtaagcctgctccctctcaggataattaatgcaacaattacatattttaaaagaagggcattgatttttttttttttgcctcttgtttttaaaaatcctaagtctcatgtcagtggatatcataaaacttaaaaacaaatgcaaattgactcacaagagttggataatatcttgtgataacctctttaaaatgactgtctgtctttctaggtttcaggtttgctggtgctggattatagtaaagactacaaccactggctggctaccaagagtttagggcaatggctacaggaagaaaaggttcctgcaatttatggagtggacacaagaatgctgactaaaataattcgggataaggtataatcatcatctttagccaaatctatgtt

SEQ ID NO: 325934 - DNA, 112 bp, Homo sapiens
ggcacgaggagaaattaaagacatccaaatttaaggtactgtgccttttagaaagttttcaaaaactaagatatgctctttagcacactatacgattatgctttttaattca

SEQ ID NO: 325935 - DNA, 5883 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaatacgaggctgaccacacccaccaaagaaaaacactttttgggcgcgctgggcctcagaaagattttttaaacctttggttttggggcgcggccccttgtgttggtcaccttgggccaaacggttcccagggaaaccg

SEQ ID NO: 325936 - DNA, 5643 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagacagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgcattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325937 - DNA, 5689 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325938 - DNA, 5686 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggtagtgtccaatttctttgttatctctcatgccatctctgaacatgttgaagatgcaggtgtccactcgggagatgccactctgatgctgcccacacaaaccatcagccaaggggccattggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325939 - DNA, 5691 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttagataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325940 - DNA, 2184 bp, Homo sapiens
ctttttttccccttccttttccagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgcattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325941 - DNA, 5643 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgcattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaataaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325942 - DNA, 5645 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgcattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325943 - DNA, 1406 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaaatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325944 - DNA, 4022 bp, Homo sapiens
  misc_feature (3838)..(3838): n is a, c, g, or t
  misc_feature (3962)..(3962): n is a, c, g, or t
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgtaacgtcaattcttgcaaggaatgatgcttgggatgagtgactngaagctctcgacctcccattgttcaagactctgcgtgacttatgtgggcacaagtgtgatgaagatgtgtgtaacacttcacatgacatcatatctgtgcatgtgcataagtcatgttctgccngtgagatctgccatctaatgaatgctcatgaagtgctgttgtgagatatcgctctaagat

SEQ ID NO: 325945 - DNA, 598 bp, Homo sapiens
aacctctttttaaaaaaatcttattttagtaaaaagcctcccgtgggatagaacctgttttcttgattcctaactcattactctttcattataccacatgtgtctctatccaacgtagtcaaagaaccttaaaacaaatggtggtcctgcctgatggactaacaggatgatcatgttttagtacaacatgactactcaacatggcccttcagaaaaatgtgttgagtgcctactctgtgccaggaacatttggctcaaaacatggatttgcatattattgcttatgaagttcaccaatgtgatttaacttacttaacatcctgggttaaaagcaatagaagtgtagcagaagattgatgttcagaatttctcatttttttactctgagaaagaacctgggtattaagagtcctatgcctaactgtagcaacaatttactgtgttctgacaatacagtcaccctgggtcagagaaaagaaagagtggagaaattatttactgctcaagaagatagatgaggccaagtttgtaacttgaaaacaatatgctggatttaatctcctccaatttcactgtcactacaatttttttcttatag

SEQ ID NO: 325946 - DNA, 384 bp, Homo sapiens
ggcacgaggagaaattaaagacatccaaatttaaggtactgtgccttttagaaagttttcaaaaactaagatatgctctttagcacactatacgattatgctttttaattcaggtggtgaaggatgctacccggaagattgcaaaggcttttgccatctctggtccattcaacgtccaatttcttgtcaaaggaaatgatgtcttggtaagaaatgccaaggtgcctgagaggacaccaccactgtgttacgtcatgttggtttgcatctctctggtaatcttctctgtgaacaccagacaaagagcaactgagacccctggatctgtttgtgtctgagtgtggaatgatgcatagcatataatgtctaccttatttgaaggcc

SEQ ID NO: 325947 - DNA, 780 bp, Homo sapiens
caacacttgcttttcagaatgagatgagggaataatagaacatttctagattcactctccccacataagttggtttacctgattgccagactctcttggtgtggtctgttctgccagtgtgctcagcttttaaaatgttgagtccttgttcttgttgacagattgaggatgcactgaaggcagcagacaccattggctacccagtgatgatccgttccgcctatgcactgggtgggttaggctcaggcatctgtcccaacagagagactttgatggacctcagcacaaaggtatgtatttttgtagacaatattcttaccaaccaaaaaaactggcttgatagaccttttcaactagagaaagttatgtagatgagaaattacattttctttattaaatcatgatcatgttctccaaaagcgtattccaaaagatgacacttttgcgagagcatgcagtgcaactcttcatgccaggatgcaatgataaaccacatggttcaaggtaaaccagtggtcactttacctcaaattccacttttatagtacaatctattgacttcaaggagatgaacttaattcaactccttcttcctttgtttcaaaatctactctcaaatatttaaaatgctaaaatatgttttagtggttaaggaaaaataggacataatgtctcatttttaattttttagaaataatgtggctggcatgggtgacatccagaaagtgaaacaaagcacattgagtagtttgactttactcaaaattaaggtgtctaaaa

SEQ ID NO: 325948 - DNA, 684 bp, Homo sapiens
caaagatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggtaatacccatattgattgtttctgataaaatactatggggtatagtttagcagtgaagcaaaggtgtcccttacaaggcaaatacagttttgaatgtagctctgaagtactaatgtattaatgtttcctttactgtggaacctactgacttagcaaatgctaatttttatcttatctgagtaacatgacagtaatttttacccaacataaagaatgatgacaattcttgtgaacatgtaaaatgtaagtacactgcttgaaaaagaaacatcttttctttcatagatagctttctgtgactagatactattgcttacagtttggatttaaaaaatggagctgcttatatgtgtgtgagccacattatggtacacagtgtgttaaggtctgttctataaatagggcttactgaaaagttctc

SEQ ID NO: 325949 - DNA, 790 bp, Homo sapiens
ctttaaggaatggttagtcaagagaaagtctagcaaaattatactttggcaaagaaacatgttattaaattcatcattcttgtgtctcttttccagcgaggagctgaagtgcacttagttccctggaaccatgatttcaccaagatggagtatgatgggattttgatcgcgggaggaccggggaacccagctcttgcagaaccactaattcagaatgtcagaaaggtgcaatgaaccttgaattcatgtgtatctgtgtgggaggtgggggcttccgctctataccctcaaagggctgtgatacattttatttattcaggcatttttcaatgctggtatttgtgacttctgaggcagtgtcagtagagatattctgtaggggaaccaatgaggagagaatatcagagaaaatagggtttttcttcaggcaaagtaacttggggatcatgtccttgagttaaaagaactggagtccaatggccaaatgtattttgctttacagttttaaaccgacaactcatggttccttatcatgaccttgggacccataagacctgcaggtctctaaagaaatattaaattagatttagtttagtttgaatgtaaagtacatcttaatgaattataatgctacaaatttgtcaattatgtccttttttatattcttctttaattcagttactattctctttaccttcttaagaaaaaaggatacctcatttttgttcattcagaagcaacattttttggaactgtactaattggttaataaaaattctccctgatttag

SEQ ID NO: 325950 - DNA, 5697 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgcattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325951 - DNA, 5693 bp, Homo sapiens
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325952 - DNA, 2017 bp, Homo sapiens
ggcacgaggagaaattaaagacatccaaatttaaggtactgtgccttttagaaagttttcaaaaagtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcctatgtgcttatgtgtagctttttactttttatggtgctgattaatggtgatcaaggtaggaaaagttgctgttctattttctgaactctttctatactttaagatactctatttttaaaacactatctgcaaactcaggacactttaacagggcagaatactctaaaaacttgataaaattaaatatagatttaatttatgaaccttccatcatgatgtttgtgtattgcttctttttggatcctcattctcacccatttggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttgcagttttgttttctggactatatcagcagatggtagacagtgtttatgtagatgtgttgttgtttttatcattggattttaacttggcccgagtgaaataatcagatttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcagcctttgttacttttaaatattttctgttattacaagtgctctaattgtgaacttttaaataaaatactattaa

SEQ ID NO: 325953 - DNA, 4313 bp, Homo sapiens
  misc_feature (4185)..(4185): n is a, c, g, or t
  misc_feature (4197)..(4197): n is a, c, g, or t
agatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgcattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatnattccgccagantccttggggggctgaacaatacacatgaaggttaaagtggttgcacggagccaattctgtttaacccaccaatgtctgcacccagggcatggcctttaggaaggagccccctcttt

SEQ ID NO: 325954 - DNA, 1037 bp, Homo sapiens
gcggccgcagtggaaggagcaggcgcttgagctcgagcgacggcgctggcggagacgccggctgctcctcccctccccgccggtgagtgagcgcccccgccccggacgctggcggcggtcgcggccccctcacggccctccgcggtgggtggggacagtcgtgagggagcgtggcctggcggcgcagcggacgcgggcctggcctcccgctcgcggcctgtcggggctgggacctgccgtcgcccccgttcgaggttgaagccccgggcctaggactcgacccccagcatcccacggggcctctttcctttcccggctcattccgctgtcattttgacctggggttcccctccagcccctcgcctcgttcccttcccagcatcccagggccgaggtgagggaggggcgtgtgagaagtcgggccgaggcccgagggactgtttaggagccggttcccgtcggaatctggggttttaggagccctcgatcgccatggcgtcccagaagttagccaccaggactcagccatttccacctgaaaccagttttgcacctattgttttgattttgaactgtctttcgaggggaggagggagcccggcgtactggggagaatatgtggtgggaggtgggatgtgaggaggagctggctgggcttggtctcggcctcaggatgccccctgttaacccctgtaggataggggaaagaggtgcagcgagttgcaccttccctaaagggccagagattcgtttatagcttgcgaatctctgctttttcagcctcggtaaaggggtatcatttgtggttggtttggttcgtcccttaacaacattcttggtgaggaatccccaggtgaatctgccacggagtgaagcagcccacttgagctgttggctacccccggcccccgcaacgcccgttggcttttgtgacacgttacacgttagtgttggtagagcctagccgtcagaggtacctgtaccataagcatctctacgaaaggtgtgaattcctaaattagcttattctgttctta

SEQ ID NO: 325955 - DNA, 435 bp, Homo sapiens
gcggccgcagtggaaggagcaggcgcttgagctcgagcgacggcgctggcggagacgccggctgctcctcccctccccgccggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggagcttttcctaaaaggattgtacaccttagaagtgcttaaggaagagtgatgaaggcaagtatccaactctttgtagtcagtgaaatttaacttggttcatgtc

SEQ ID NO: 325956 - DNA, 486 bp, Homo sapiens
gcggccgcagtggaaggagcaggcgcttgagctcgagcgacggcgctggcggagacgccggctgctcctcccctccccgccggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggaggcagtccgttgccactgggcagtatagatatgttgtccagcctgccatcactggactgtagttaaggtggatgtcttgtccagtctgctgccactgggctgtatgtaaggaggttcttctgtccaccccaccgctactggactctcttccctg

SEQ ID NO: 325957 - DNA, 596 bp, Homo sapiens
gcggccgcagtggaaggagcaggcgcttgagctcgagcgacggcgctggcggagacgccggctgctcctcccctccccgccgcttttcctaaaaggattgtacaccttagaagtgcttaaggaagagtgatgaagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccggctctgctatgatggaaatagcttgtgctgctgctgctgctgctgctgcatgtctaccaggagaggagggaactgcggagcggatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcc

SEQ ID NO: 325958 - DNA, 1706 bp, Homo sapiens
gcggccgcagtggaaggagcaggcgcttgagctcgagcgacggcgctggcggagacgccggctgctcctcccctccccgccggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggagatggtcctagaacaattggagattcatacgcacacaaagaacctcaacccttacctcacaccagacacaaaagctaccttcaaataaatcataggcctaacttgaagagctaaaaccatgcaactccagaaagtttttgtcagaaagaaaatacaggagaaaatcttagtgaccttggggtaggcaaagatttcttaagacacaaaaagcatgaagtataaaggggaaaaaatcgctaaattggatttcatccaagttaaaaacttttaatctttgaaagatacctttaagaaaatgaaaaagtacgccttgggctgggagaaaatatttgcagaacgtgtgtctgacagaggatgtgtatctagaagatataaagaattgtaactcaagaattgaaagacaaccccataagaaaagggggaaacaatttgaataaagttcatcaaagaatataaatggcaaataagcacatgaaaagatgcccaaagtcgtaagtcattagggaaatataaatttaaaccataatgagataccactgcatactccctagaatggctgtaatgaataggattagtcacatggtgacaagaatggaggatcatctggaactctcatacactgacgataggaatgtgaaatggatcaactactttggaagacaattgggcagtttctttcaaagtaaatgtgaagatgccatacgattcatccattccatttctaattattcaagagaaatgaaactgtatatccacaaaaaagacttgtacacaaacattcacagcagctattatttattggtaatagctaaaaactgtaaacagctcccatatccatcaagtgtatggataaacaaatttggtgtatttatacaatggaatactactcggcaataaaaagaacagttgatactctcaacaacctagatggacctcaaaataattcggtttaatgaatgaagccaaacttaagaagagtacattgtatgtacttggagaactaacttcttgcaatagatttttaagcactattaggagcatatgacttaaacagtttttaaaagtcagggagtaagtatgcttaaataaaatacaatctgtgaaacaaatctctgaattattatcacttcactggacactctaacttgaccatatttctgactttaatgtaactcactcttattccgtagtcacatgtttgcttgctcattggttcacattacatttattcagcatctgcttgagccaaggcactgtaactacatgttttttttagttacctacttttgtaaggtcctgtttctttggctacatctgattacagtaaacataggaagtttaataaaacaattttcatgaccgaaaaaaaaaaat

SEQ ID NO: 325959 - DNA, 1455 bp, Homo sapiens
gcggccgcagtggaaggagcaggcgcttgagctcgagcgacggcgctggcggagacgccggctgctcctcccctccccgccgatggtcctagaacaattggagattcatacgcacacaaagaacctcaacccttacctcacaccagacacaaaagctaccttcaaataaatcataggcctaacttgaagagctaaaaccatgcaactccagaaagtttttgtcagaaagaaaatacaggagaaaatcttagtgaccttggggtaggcaaagatttcttaagacacaaaaagcatgaagtataaaggggaaaaaatcgctaaattggatttcatccaagttaaaaacttttaatctttgaaagatacctttaagaaaatgaaaaagtacgccttgggctgggagaaaatatttgcagaacgtgtgtctgacagaggatgtgtatctagaagatataaagaattgtaactcaagaattgaaagacaaccccataagaaaagggggaaacaatttgaataaagttcatcaaagaatataaatggcaaataagcacatgaaaagatgcccaaagtcgtaagtcattagggaaatataaatttaaaccataatgagataccactgcatactccctagaatggctgtaatgaataggattagtcacatggtgacaagaatggaggatcatctggaactctcatacactgacgataggaatgtgaaatggatcaactactttggaagacaattgggcagtttctttcaaagtaaatgtgaagatgccatacgattcatccattccatttctaattattcaagagaaatgaaactgtatatccacaaaaaagacttgtacacaaacattcacagcagctattatttattggtaatagctaaaaactgtaaacagctcccatatccatcaagtgtatggataaacaaatttggtgtatttatacaatggaatactactcggcaataaaaagaacagttgatactctcaacaacctagatggacctcaaaataattcggtttaatgaatgaagccaaacttaagaagagtacattgtatgtacttggagaactaacttcttgcaatagatttttaagcactattaggagcatatgacttaaacagtttttaaaagtcagggagtaagtatgcttaaataaaatacaatctgtgaaacaaatctctgaattattatcacttcactggacactctaacttgaccatatttctgactttaatgtaactcactcttattccgtagtcacatgtttgcttgctcattggttcacattacatttattcagcatctgcttgagccaaggcactgtaactacatgttttttttagttacctacttttgtaaggtcctgtttctttggctacatctgattacagtaaacataggaagtttaataaaacaattttcatgaccgaaaaaaaaaaat

SEQ ID NO: 325960 - DNA, 524 bp, Homo sapiens
gcggccgcagtggaaggagcaggcgcttgagctcgagcgacggcgctggcggagacgccggctgctcctcccctccccgccggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggaggtaggatgaattggacaaggatgagactcgtgtaggtgaggacagttggaaggatcatgatgtcgtaatcttggagttaggtgaaacagcttttcctaaaaggattgtacaccttagaagtgcttaaggaagagtgatgaaggcaagtatccaactctttgtagtcagtgaaatttaacttggttcatgtc

SEQ ID NO: 325961 - DNA, 421 bp, Homo sapiens
gcggccgcagtggaaggagcaggcgcttgagctcgagcgacggcgctggcggagacgccggctgctcctcccctccccgccggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggaggtatgtcgttttttcttctactgcaaaatcacatcacccaggcactcagaacagtataaaataattatactttcctctctataactca

SEQ ID NO: 325962 - DNA, 466 bp, Homo sapiens
atgatggaaatagcttgtgctgctgctgctgctgctgctgcatgtctaccaggagaggagggaactgcggagcgggtaagtttgtaagattttgtttttctgttaacttactgtttttcatacctaggactctccagactttcctttggtaactaaaaagatatctcagcaaataccttaaagttgtggtaaaagaatttttccccttttcaaatgggtaaataataattatagctaatgaatgaatgcttagaattatattcctatttccttcctaacatagtgctatattttattttatcctttcgttaaaaccttaagtatatttcatgtattctttctgtatatttgagggtcagttttatggtagagcaataaagatgctttgtttcttattgttttgattttgcacatggagatggctttcttacattaatgaatgtagtgaataaagttctagaatctg

SEQ ID NO: 325963 - DNA, 571 bp, Homo sapiens
ggaaatataaagaaggaagagaataggtgactgttgaagcgattacaggaggatttgatctgtgttctctatttgtaatgttgaagaagaaggctatcattgcaagtatgaaaaataacatggatgaaagcatggagatacttgaatcgtacatttgtgtttctgtgtttgtgagactagcccgccctacccatttgctgaccttttggagacaagcttagttttgagtaaggtcattttaagatatgtagagtggactttgagaggtagaattgaaacaaaggaaatgaagaagtgtttttttttttttaactcataggtaggatgaattggacaaggatgagactcgtgtaggtgaggacagttggaaggatcatgatgtcgtaatcttggagttaggtgaaacaggtatcaaaaaataacttttcctgtcctatagtgagaataaacatttataaaaatattgttgataaagaatttgtttttctttagtatttgtttttcaaaagtatttcatttgtttttcaaaagtatttcaagtttcaaacaggaactttaaaaaatctgtagc

SEQ ID NO: 325964 - DNA, 519 bp, Homo sapiens
gcggccgcagtggaaggagcaggcgcttgagctcgagcgacggcgctggcggagacgccggctgctcctcccctccccgccggtattaatctctggagaagacacatccacagttagcactttcttcagatgctgacgctcggtgaacagttgcctttggtcacaagatttagaagacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggagatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcc

SEQ ID NO: 325965 - DNA, 271 bp, Homo sapiens
ggaggttgcagtgagccgagattgcaccacggcactctagtctgggcgacaaagcaaaactctgtctcaaaaaaaaaaaaaaaaaaagaagaagaagaaacagatgtatcctcccttcatggccatttacctcccttacctgtgtttctcaaatccaataccatcaccaggtacacaagcaggaaacccaaactctacttcctgtccaacagtgtcatcaacataatctgaaggttgtgccttccaagggggggggggggggggggaattc

SEQ ID NO: 325966 - DNA, 980 bp, Homo sapiens
ggaggttgcagtgagccgagattgcaccacggcactctagtctgggcgacaaagcaaaactctgtctcaaaaaaaaaaaaaaaaaaagaagaagaagaaacagatgtatcctcccttcatggccatttacctcccttacctgtgtttctcaaatccaataccatcaccaggtacacaagcaggaaacccaaactctacttcctgtccaacagtgtcatcaacataatctgaaggttgtgccttccaaatgtgagccatgactcaatcatttcagtccacacagtagttaccatatattagatacctccaatatcaacgcttccccagatatttgcatctatgtgtccagctgcccatttaatagctccactaagtagtatctaatacatttcagaatcttaatatgggtgtgatattgtgaaatatatatttggtcatctccttttctggcatgcaactcctaaaattcatgaaattctcaaatttataagtgactttgaatggcaatgagttgactgatggttggaaacccctagataacttcagaatggagaccggtcagggaaaagagactatgtcaggattcgaggtctggaaatttcagccccataccccaatctccagaaaggggagagggggccaaaggttaagctgatcagcattggccaatgatttaattaatcatgcctatgtaataaagcctccataaaaccccataaagacagggtctggggagcttccaaatagccaaacacatggaagttcctggatggtggtgtgcctgaagatcataaaagctctgggtcgcttccccttatgcatctcttcatctgtaacctttgtaataaatactctttaaaataaactggcaaattaaagcatctcctgaggttctgtgactggctctagcaatttaatggaagccgaggaaggggtcatgggaacctgatttttatcaagtcagtcaaaggacaggtaaa

SEQ ID NO: 325967 - DNA, 628 bp, Homo sapiens
ggaggttgcagtgagccgagattgcaccacggcactctagtctgggcgacaaagcaaaactctgtctcaaaaaaaaaaaaaaaaaaagaagaagaagaaacagatgtatcctcccttcatggccatttacctcccttacctgtgtttctcaaatccaataccatcaccaggtacacaagcaggaaacccaaactctacttcctgtccaacagtgtcatcaacataatctgaaggttgtgccttccaaatgtgagccatgactcaatcatttcagtccacacagtagttaccatatattagatacctccaatatcaacgcttccccagatatttgcatctatgtgtccagctgcccatttaatagctccactaagtagtatctaatacatttcagaatcttaatatgggtgtgatattgtgaaatatatatttggtcatctccttttctggcatgcaactcctaaaattcatgaaattctcaaatttataagtgactttgaatggcaatgagttgactgatggttggaaacccctagataacttcagaatggagaccggtcagggaaaagagactatgtcaggattcgaggtctggaaatttcaggggggggggggggggggggaattc

SEQ ID NO: 325968 - DNA, 291 bp, Homo sapiens
ttgcaagtcatcaaagcttaagtcaatctgtggtgtgtctaacgggtactttgaagtgtatcaactaagctaaaatgctactagagataatacaccaaagttattctgagaagtaatgataagctctagccaaagccacactgtttgcttgcatctttcagtgtgtgacaacagatagagcttaaaataattttacaaggacaatggcatttgctaaatgcttgctaccaagtctttgaaatttctcattttctgttattcacttactctttacacattgggaagtaattg

SEQ ID NO: 325969 - DNA, 1505 bp, Homo sapiens
aggggcttctgatggcatcgcccagaaaatgctggaaccagaactggtcagagactttgaagggcacagcctggcgggctactccccaagggtctcaggtctctgcccacctgactaccctgcagcaaacgcttctctgtaacctgacttctcccttcagacctcagcctacaaccatcctcttcatgccaggaaccaactgcttctcagcctcggcttagggtcttaagttcaccagaagggatcggggtttgcgttgatattataaggaatcttcccagaaggagctgcccttcatccatccacaagaatacattgagttcatttagttcttgaccaggtaagaaaagaataaaggagaacaaatattaaatactcttttctaattgatgccttactactgttttgaagctgagccgaaatcaaattgatgtttacattttctatcaagtacacatgagctgtgggagtctagcatattcttgtccaaaagagagagactttcaaatgaattcctattcctcttggtcccctccacctattttggaggtctgcatgtggagttgtatgctattttccaaggtacctcatttaaaaaaaaaaaaaaaaaaaaactgcctctcatttgttcccttaaaacgtctctctctctcataaaactaagttatcattgaaatattaaacgatctgaagcgtcttttttttttcaaataaatgtcaaagatggtaatagtttgtaaatcagtaaatcctctgtccatctgcccattgtccatggtcctgataatagagccaagatggattttcacatgtaaggtgttagtccattaatccagccattaaaagtagttgggagattgaagattagatggtttctggagcaaccgaatttgcagctgccacaaaactagataaatagccacaactggagttattttttgatctcataaaccccaggaattacacacagaatggattgaaaagcagacaagcatcttgtgctattgcagagacttttctacccaggaagtgttgaatttttaaaagaaacttgatattggtgataaaggtatgaatgaacaactctcttacttgccctcgatgtttcaagatgcctggtgaaaccgagaggccacatggcatgtccaaggagacatgctttctgggttctatatgaatagagatggttttagcctgcaattgaaaaaaaaaaaaaaaaacggttgaagccttgctaactttttcccagagcattctgggttgatatttcacagtcaaacgttttggcatggaaaaaaaaaaaaaggcattttaaactcttagtgaattcaaagctctaaatccaaacaatggtgaacacatgtacataacatttcatgttttcagagatacgtatgcttatttaagtgcctttcatgttttaatcaatgtttgcagaatttatcttaaacctgagatgaattaaaaaatttttctccttcaataaaaactgctaatggcaaaaa

SEQ ID NO: 325970 - DNA, 729 bp, Homo sapiens
ctcaaggccaagaattcggcacgaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaac

SEQ ID NO: 325971 - DNA, 331 bp, Homo sapiens
gtgtttctcaaatgtatttggagtgggaagacagcttctaatgaaagctacaggagattttgacatactctttgaaaattggtattaccattactattttatttcccagtttattctggcctctacctgtattagatactttaaaaatgtctttgcaattgcttgccttaggttgttactaggcctcacactgggtttgtgacagagtggcaaactatgaaatttgaagattgtgggttgaattttattttgctttaagcgccacagaacacagctgaaactggagtgccatcttcggtggtgtttacatttttatttttgtcgtctttta

SEQ ID NO: 325972 - DNA, 221 bp, Homo sapiens
ttggggaatcacccccaaagagagatttgggtttaaaaccccccccaaaggattttatttttaaaaacccccggggtgaacccccacctcctataactccaccagtatccattcctcctcctcacactccaccaataagcatcccaaactgtaagcatgtttttttctttgtgtttgcttatcctcttggagctgggtgtaggaggataagcaaaaaaaaa

SEQ ID NO: 325973 - DNA, 4150 bp, Homo sapiens
cgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaac

SEQ ID NO: 325974 - DNA, 2405 bp, Homo sapiens
cgctggattgcactgcaaaaagattttgtctgatgttaagtaattacaaggcacccctagacttggaaaagtagtccccagtatactactaggctattcagggaacttcagcctttccctgttaaactttttccttttctctaagttttatgttggctgggttgggtgagagttggtaaggagaagatgccagtgaaatttccatcctaggacaaagtgagaattaaagggtaaccagttctgtagtgagaataaggctttgaatgagatccaagcctagctggtccagattgctcccttggtgcccgagtcggaatggatagaatgatagagaataataccctcaagacttacgaccttgctttgttttctttttatattttcactaatggtgaaatagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaac

SEQ ID NO: 325975 - DNA, 3955 bp, Homo sapiens
cgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggtaagttatttttttttatcattagttttccttgccccacccccccccacccccccacccatccccaagttagatttttttaaaaaaacaatgttaattttggtaaaattatttccaagactggcttttttggttgttttgtttgtttgtttgtttttgaggaagatcttcctcttaaagtcaaatatgtgtacttgatctttaccaagagagaatctcaaagacaaaatcatgtttgtctgtcttgaataaaagtttggatcttcacatccttatttggtatagaaaaatgattaaaagtaatctctgtgcaaaggaattggtacagagttcgtaattcacttaaccttagtctcttcccagcttttaggagatacttctttaacggcataggtttttctctgtctggaccaattattatctatctgaaacccctggacttgggtagcgttctttgtgggctagcaaagaaatcatctttgatacattccaataaaatggctttgttttctaagtaacagttgcgcagcctgaggtaccactttcccactcactctcagtttacttggctggagtttatctgttgtactttttacccacaacttcaatactgtgatcaagggcgatgtgacttagatcttttacatctttaagcaggcttactcttgcctgcttaagttatgaataaatacatcacatgcttgttacagtagaccatcttttaaattaacaaattgttgtatttgaagtggtattgccaaatataattaacacttgaatcccctaactggaagttaatatcttgagagtattacagtgttctagtcctgtgagcccatagtatttttcaaaggtatatgcatatgcctgtttgctttcataatctgagttgttttaggaaagaacctattgattacctctgagatgtaggactgtgagacattggtttgtaatggaggacttttacttttcacctatgctattcagtactgttggaattttttattttttgcatgtactatatttataataaaaaaacaatttgttttt

SEQ ID NO: 325976 - DNA, 2109 bp, Homo sapiens
ctttgaatgagaatccctgggattcttatcccagcaaacctgtcttgttgctattggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaactttaatgtgtgctattcttcctacactgcattaaggtggaaaaggattgttcaccgtcaaagtttgagctgttaatactgtattggagtctaaattagacttatttgatgaaaatagacattttatgtagttattctcactttcatatgtaatacttttgatttttagtgctcagtcataaggtaaaggttagttgttttaatgtcaattgaaaagctgtgtttgcaattcaatcgaggttttctttttttttccattggctttgtggtatatgttgccctaatttgtaaggagattttgctgggtgaaaagttggatcccagtgttacacgttgtactataaattatcggactgcctgggtattacgttagaaggttgcgtgtgtgtgtgtgtgtgtctgtggttttttttttttccaaccatcccattgaatttttcaaaagggtaaaagaatcaaggttaacatttgcaacctaagagctttttgttgtgtttgaggacttcagtgcagcctactactgtttccttatataagccttgcctgttgcctttcttcaccagcgttttaattcccctgcggggcagaggtaaacgaacttttcccccacatat

SEQ ID NO: 325977 - DNA, 2784 bp, Homo sapiens
cgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactgtaagcatgtttttttctttgtgtttgcttatcctcttggagctgggtgtaggaggataagcaaaaaaaaa

SEQ ID NO: 325978 - DNA, 844 bp, Homo sapiens
catctacaaaaaaaccagttttttccaacttttatgtatatctttcactatcccagttctctttctggaagtactaatgcagttttctagaatttttaaaatgtatgtgagatttactatttaaacttgtggtgttgtaatatagttcatgaatattttgtgtaatgattttttaatgtaagctacagtgctgctcattatcaaatgtgaatctctttatgattgtaattttattttaagtttgcagtactaccctctgggtggggcagctggacaaaagaactactcagcaggatgttgccagtctcttggaagagtttggtccaattgaatcaattaatgtgagtgtttattcagttttttaagtacgatggacaggtgtgattaatgtcattttatgaaatggaggacctgagaccaaagttacaatttgcccaggtttatagatgtgactagaatttaggtgttcagagtccacgtttagaattatctgtatttaacatttcttagaattctttgtatttaacatttcttggataaccaagtttaatttcaaacatttctaggtaagtctttatataacaaagcttggaggactcagttgagaccaaacttgaattgccaacttagaaatgaatttaaccttacattatatagcatggggtgagggatgggattgttggaactgcttacttggtgttgtatcttgttgcttttcaattttgttatcttttataatattaaaatgttttggagcagatgattcctcccaggggttgtgcctatattgttatggttcataggcaagatgcctatcgtgccctgcagaaactgagccgaggaa

SEQ ID NO: 325979 - DNA, 233 bp, Homo sapiens
  misc_feature (9)..(9): n is a, c, g, or t
ttgactctngaggatccgtgatgttatccccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggagtgttgggcgataacatcacgggt

SEQ ID NO: 325980 - DNA, 3574 bp, Homo sapiens
cacaatggtatgattttttgcacatgaaacagtcagagtttatgtgtattgaaggaatttttctataagaaggaaacttgagtttacatcttggaaggtatgattttctttccataattcctatttataataaaggtctgctcttctggtagttgttacagtataaactctagtgccacaatctctatattttatactttgttaaattggataaaatgttattttagcaaagaagcttaattaggaaaacttgtaggttaactttttttttaggccttaatgcccttttcttttttaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaac

SEQ ID NO: 325981 - DNA, 4841 bp, Homo sapiens
cgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaactttaatgtgtgctattcttcctacactgcattaaggtggaaaaggattgttcaccgtcaaagtttgagctgttaatactgtattggagtctaaattagacttatttgatgaaaatagacattttatgtagttattctcactttcatatgtaatacttttgatttttagtgctcagtcataaggtaaaggttagttgttttaatgtcaattgaaaagctgtgtttgcaattcaatcgaggttttctttttttttccattggctttgtggtatatgttgccctaatttgtaaggagattttgctgggtgaaaagttggatcccagtgttacacgttgtactataaattatcggactgcctgggtattacgttagaaggttgcgtgtgtgtgtgtgtgtgtctgtggttttttttttttccaaccatcccattgaatttttcaaaagggtaaaagaatcaaggttaacatttgcaacctaagagctttttgttgtgtttgaggacttcagtgcagcctactactgtttccttatataagccttgcctgttgcctttcttcaccagcgttttaattcccctgcggggcagaggtaaacgaacttttcccccacatat

SEQ ID NO: 325982 - DNA, 4765 bp, Homo sapiens
cgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaagaagttgcttgatagatttgactatgatgatgagccagaagctgtggaagaatcaaagaaagaggataccactgccgtcaccacgacagcacctgctgccgcagtaccccctgcacccaccgccaccgtgcctgctgctgctgcacccgctgctgcctctcctcctcctccacaggcaccatttggctttcctggagatggcatgcagcagccagcatacacacagcatcaaaatatggatcagtttcagccacgaatgatgggaatacaacaggatccaatgcaccatcaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggaaatggaagtagaacaaccttgtattcaagaggttaagcgacatatgtctgataacagaaagtcaagatctaggtcagcatccaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtgtttgcagtactaccctctgggtggggcagctggacaaaagaactactcagcaggatgttgccagtctcttggaagagtttggtccaattgaatcaattaatatgattcctcccaggggttgtgcctatattgttatggttcataggcaagatgcctatcgtgccctgcagaaactgagccgaggaaactataaagtgaaccagaaatccataaagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccagattggaaaggaattcctaagaagcctgaaaatgaagttgctcaaaatggaggtgctgaaacctcacacacagaaccagtatcacccatacctaaaccattacctgtgcctgtccctcctattcctgttcctgcacctataacagtgccacctccacaggtcccaccacatcaaccgggtccacctgtagttggtgctctccagccgcctgctttcacgcctcctctgggaataccgcctccaggctttggtcctggtgttcctcctccccctcctcctccaccatttttgcgcccaggattcaacccaatgcatttaccaccaggttttctgcctcctggacccccacctcctataactccaccagtatccattcctcctcctcacactccaccaataagcatcccaaactctactatcgctggtataaatgaagacactacaaaagacttatctattggaaatcccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggcactcaaggagttgcccctggtcctgtaattggacttcaggcaccatctactggtcttcttggcgcccggcccggtctcatcccactccagcgccctccaggaatgcccccacctcacttacagcggttccctttgatgccgccccgtcccatgccaccgcacatgatgcacagaggcccaccgccaggaccagggggctttgcgatgcctccacctcatggaatgaaaggtcccttcccaccgcatggcccctttgttaggcctggtggaatgccagggctcgggggcccagggccaggcccagggggtcctgaagacagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaactttaatgtgtgctattcttcctacactgcattaaggtggaaaaggattgttcaccgtcaaagtttgagctgttaatactgtattggagtctaaattagacttatttgatgaaaatagacattttatgtagttattctcactttcatatgtaatacttttgatttttagtgctcagtcataaggtaaaggttagttgttttaatgtcaattgaaaagctgtgtttgcaattcaatcgaggttttctttttttttccattggctttgtggtatatgttgccctaatttgtaaggagattttgctgggtgaaaagttggatcccagtgttacacgttgtactataaattatcggactgcctgggtattacgttagaaggttgcgtgtgtgtgtgtgtgtgtctgtggttttttttttttccaaccatcccattgaatttttcaaaagggtaaaagaatcaaggttaacatttgcaacctaagagctttttgttgtgtttgaggacttcagtgcagcctactactgtttccttatataagccttgcctgttgcctttcttcaccagcgttttaattcccctgcggggcagaggtaaacgaacttttcccccacatat

SEQ ID NO: 325983 - DNA, 1346 bp, Homo sapiens
ctcaaggccaagaattcggcacgaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaactttaatgtgtgctattcttcctacactgcattaaggtggaaaaggattgttcaccgtcaaagtttgagctgttaatactgtattggagtctaaattagacttatttgatgaaaatagacattttatgtagttattctcactttcatatgtaatacttttgatttttagtgctcagtcataaggtaaaggttagttgttttaatgtcaattgaaaagctgtgtttgcaattcaatcgaggttttctttttttttccattggctttgtggtatatgttgccctaatttgtaaggagattttgctgggtgaaaagttggatcccagtgttacacgttgtactataaattatcggactgcctgggtattacgttagaaggttgcgtgtgtgtgtgtgtgtgtctgtggttttttttttttccaaccatcccattgaatttttcaaaagggtaaaagaatcaaggttaacatttgcaacctaagagctttttgttgtgtttgaggacttcagtgcagcctactactgtttccttatataagccttgcctgttgcctttcttcaccagcgttttaattcccctgcggggcagaggtaaacgaacttttcccccacatat

SEQ ID NO: 325984 - DNA, 1440 bp, Homo sapiens
cgcgcggcgtggactcgggccgctgccgccatcccgctggagagagggagagagaggcccgcccgctcgccggccgggccagtgtgagccagtgcgtgagggcgcggggggccgtgtcagcgagacgcagagcgcagccgccaccaccaaacggacatgttgaagaccagcgctgccgccgcctccttttcctcatcctgcgaacgggactgagagggggcccgccacctctccgcctctgcctcggccgcccgcctcgccgcttcgggcgcagcctcttcctgcccgggcctcggactccgccgctcgtcgcctccccccggccaccaggcccggctggtttcccagccccgctccgccgcggcgcgaggtctatgtgaccggcgggcccggagcagccgccgccgcagcgcgaacatggacgccgtcaacgccttcaaccaggagctcttttcgcttatggatatgaaacctcccatctctagagccaagatgattctcatcactaaagctgctattaaagctattaagctttataagcatgtagttcaaatagtagaaaagttcatcaaaaagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggctcacctccacctccagtaaaagtttcttctgaacctcccacacaagccactccaaactccgtcccagctgtaccacagttgcccagctctgatgcttttgctgctgtggctcagctgtttcagacaactcaaggccaacagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaaggtatatttctctcacataacccaccccaccatttatatcactcaacttgagttatggaaattatcacttctgtatcccttctgtggattgttcattatgtcgttttgtaatttgagagattttccccctcaacaagaaaacatcgattattttccctggttttaaatgtgatatgtgctcagtgcaaaaatttccagggtttgaagctgaatttactagtgtaaaattaaaaaagtgaaaaaaaaa

SEQ ID NO: 325985 - DNA, 1636 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325986 - DNA, 1043 bp, Homo sapiens
gtgaaccggcccccagggctggctcgggatgttggcaggagcagggcatcaggctcagcccacgctccccggctccaggaacgccgacctgtccatcacgctgggtacatcgctgcagatccggcccagcgggaacctgccgctggctaccaagcgccggggaggccgcctggtcatcgtcaacctgcagcccaccaagcacgtaggtgtctgagcctacccctgcccagggccaccatgcaccctctgtcccccacgcctgacccgtcccgccccccggcaggaccgccatgctgacctccgcacccatgtgagcatcgtcgggctcattgcagcagcagtgttggttgaatagaataagtcatttttgccttcgtgtgaattcatctctctctctctgcctctccctctctctgtctctctccaattctgtctctgacttgctttgtctttaactctttatctctctgtctgtgtcttgttctatccccctctccctgttcttgcaactcaccctctatttctgtttctgattccctctctctgtctccctgtctctctctgtctcctgattttctctctctccaactttctctctatacctctctgattctccctctgtctctttttctgttcccctctccccgtccatctctcccggcctgccaccttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325987 - DNA, 1618 bp, Homo sapiens
cgcgccgggggacgccaacacgcccaactctgtggtcaccctgtcggggctgatcggggagagaggggatgtagttccaggaagaggggacgacaggcgcaaagggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325988 - DNA, 2165 bp, Homo sapiens
tctcctcttccataacctgctgtggctccccattgccaggcagtgtagagttctgaataccttgtgctggaagctgaagcccttcctgccccagccctgaatcacctctccaacttcagcccctcctgctcctgctgcagcccccaaaacacttgcattttctcctaaactcatgggctcttcccagcacccaggcctttgtttaccccttctgtctgatcttccctctcacccttcaagaaactgcttagcctcctccaggaagcccttccacgtgccccagggcccccacctccacggggcttccccaggcccaggtacctcctctgatccaggcttgactcttggggccagaggatctgtgtccacctgtctcccccaagatcaagggcttctggagggcagggcttgggcccatgtgagcatcgtcgggctcattgcagcagcagtgttggttgaatagaataagtcatttttgccttcgtgtgaattcatctctctctctctgcctctccctctctctgtctctctccaattctgtctctgacttgctttgtctttaactctttatctctctgtctgtgtcttgttctatccccctctccctgttcttgcaactcaccctctatttctgtttctgattccctctctctgtctccctgtctctctctgtctcctgattttctctctctccaactttctctctatacctctctgattctccctctgtctctttttctgttcccctctccccgtccatctctcccggcctgccaccttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325989 - DNA, 1508 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325990 - DNA, 1745 bp, Homo sapiens
tatttttagtagaggcggggtttcaccatgttggccagtctgctcttgaactcttgatctcaagtgatccacccaccttggcttcccaaagtgctgggattataggcgtgagccaccatacccggcctttgctttgtctttaactctttatctctctgtctgtgtcttgttctatccccctctccctgttcttgcaactcaccctctatttctgtttctgattccctctctctgtctccctgtctctctctgtctcctgattttctctctctccaactttctctctatacctctctgattctccctctgtctctttttctgttcccctctccccgtccatctctcccggcctgccaccttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325991 - DNA, 1453 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325992 - DNA, 2117 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggtgagccacccccacccatgccctgggctccaggggaggctgcgaggcccctgaggactctcctcagcttcctcattgcaggggagagctgagggacaccatcctagactgggaggactccctgcccgaccgggacctggcactcgccgatgaggccagcaggtctgaccccccacccccagggagcccatggtggggcggggcgggacgacagcagaaacacagccagctccagcatgggacagtggctgaggctcacaggcagtgaggggaggcttcctggagcaggtgggccaggccaggggctgcacacacgcactcacacacactcgtcacctcatggctctgggtgggtgctacacaaggaaaccaaggcttccgccaggtgtctcctctatccagtgctgcccagccgggaggtgaccgagccagggtcccaccctaggtgtccaagctcttaccacactgtgatactccccggaagtgtctaagggcccgcccagatcaatgaccccgccaacggaccgcagaggagggcagggcgggatcccaaaggctgactcgggagtggggctggccttgaccgccccggtgagcacagatggcctaggtgtgaaccggcccccagggctggctcgggatgttggcaggagcagggcatcaggctcagcccacgctccccggccccaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325993 - DNA, 1578 bp, Homo sapiens
cgcgccgggggacgccaacacgcccaactctgtggtcaccctgtcggggctgatcggggagagaggggatgtagttccaggaagaggggacgacaggcgcaaagggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325994 - DNA, 2128 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgcaaaaaaaaaaaaaaaaaaaaaaaaaaaaaaaaaaaaaaaaaaaaaaaaaaaaaaaaaaaaaaaaaaaaactcgagactagttctctgagccatggagggcggcttcggctccgatttcgggggctccggcagcgggaagctggacccagggctcataatggagcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacagacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacgg

SEQ ID NO: 325995 - DNA, 1288 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325996 - DNA, 1427 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325997 - DNA, 2164 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcaggtctgaccccccacccccagggagcccatggtggggcggggcgggacgacagcagaaacacagccagctccagcatgggacagtggctgaggctcacaggcagtgaggggaggcttcctggagcaggtgggccaggccaggggctgcacacacgcactcacacacactcgtcacctcatggctctgggtgggtgctacacaaggaaaccaaggcttccgccaggtgtctcctctatccagtgctgcccagccgggaggtgaccgagccagggtcccaccctaggtgtccaagctcttaccacactgtgatactccccggaagtgtctaagggcccgcccagatcaatgaccccgccaacggaccgcagaggagggcagggcgggatcccaaaggctgactcgggagtggggctggccttgaccgccccggtgagcacagatggcctaggtgtgaaccggcccccagggctggctcgggatgttggcaggagcagggcatcaggctcagcccacgctccccggccccaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325998 - DNA, 1717 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggtgagccacccccacccatgccctgggctccaggggaggctgcgaggcccctgaggactctcctcagcttcctcattgcaggggagagctgagggacaccatcctagactgggaggactccctgcccgaccgggacctggcactcgccgatgaggccagcaggaacgccgacctgtccatcacgctgggtacatcgctgcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 325999 - DNA, 1596 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccagggacaaactggcagagctccacgggaacatgtttgtggaagaatgtgccaagtgtaagacgcagtacgtccgagacacagtcgtgggcaccatgggcctgaaggccacgggccggctctgcaccgtggctaaggcaagggggctgcgagcctgcaggggagagctgagggacaccatcctagactgggaggactccctgcccgaccgggacctggcactcgccgatgaggccagcagatccggcccagcgggaacctgccgctggctaccaagcgccggggaggccgcctggtcatcgtcaacctgcagcccaccaagcacgaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgca

SEQ ID NO: 326000 - DNA, 380 bp, Homo sapiens
gcttccggcggaagcggcctcaacaagggaaactttattgttcccgtggggcagtcgaggatgtcggtgaattacgcggcggggctgtcgccgtacgcggacaagggcaagtgcggcctcccggagatcttcgaccccccggaggagctggagcggaaggtgtgggaactggcgaggctggtctggcagtcttccaatgtggtgttccacacgggtgccggcatcagcactgcctctggcatccccgacttcaggggtccccacggagtctggaccatggaggagcgaggtctggcccccaagttcgacaccaccacgacgaattccgccaccacgacgacatatccgcacgaccacgacgagtccgcaccacgcgcatg

SEQ ID NO: 326001 - DNA, 1236 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggagaaaaaaaaaaaaaaaaaaaagctctgagagcatcttattttgtttaaaggcaagaaataaaatttccttttgtggagctct

SEQ ID NO: 326002 - DNA, 1838 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcaggtgagtccctcggctactgggtgtgccggggagttgggggactcaacaggtaagctgtcctggggaagcgacaaagaatcttatgcagattggcgggaaaaggaggaaacatgcaccctagtgtggcccctgatggcacatttgatgacctgatatcctaagggggtggcatctgcggaggtggggtgggatgccttctcttggtagatgacatggtattacagataaggtgatgcgactgatttccataaccaaataagtaaatgccatttaggaagggtgagagggcaccgacagttctccgttgtgtgatgtataaattaaggaatggcggagtaggatgtagatgttgaaagataagtgaagagctgttcctgactaataacatgaatgactctggattccaattggtggccatctccctaaacttgagtggggagctgggtccctgcactggaaagtgagaatgaggggagttgctttgttctgtaattctcctgagggaggtgtgggccatgccagattctagcctgtacttttctctacgtggcttacagcgaccttaagttctcccaggcaggatttgtcctggagcagactggcttctgaaggaggggagggaggtgaagctgtctgctcctctcaacctccgctgcctgacccgctgcctttctttcctcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326003 - DNA, 928 bp, Homo sapiens
  misc_feature (769)..(769): n is a, c, g, or t
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggaaggtggngcattgagagaagggcatccgaggcaacagactcggggttcccattaacgattgtcgaggcgggcaaggtgagaggaaagtcgggcaggggggggcaaaaggagggcaggcgccaggaggagtcagactgaaaccagtaaacgggcggaaggaagccgg

SEQ ID NO: 326004 - DNA, 714 bp, Homo sapiens
  misc_feature (654)..(654): n is a, c, g, or t
  misc_feature (662)..(662): n is a, c, g, or t
gacggtatcgttaagcttgattaagaaagccggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggctgagtgaaatcnggtgagtnaccggggttggttcccatggggttccttaggtgtccgggggaaggggaattg

SEQ ID NO: 326005 - DNA, 504 bp, Homo sapiens
  misc_feature (345)..(345): n is a, c, g, or t
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctggtaaatcaactttaagttgccgacctctctgggcagccaggctggagaggcggctaanggtgttttggaggcttccagggtggtaccggctcccgatggccagtttgctttcctcattcccaacgggggccttcgcgcacagcgggcccctgtcatccccccgtctacaccagcaacagcggcaccttccgtgggccccaaaacgccagtgtcaccc

SEQ ID NO: 326006 - DNA, 1107 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaattttggggcggggggggggtcaccccttatccacacccttgggggtgttggggggggaaatttttggcccaattttaaacctc

SEQ ID NO: 326007 - DNA, 1207 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326008 - DNA, 1610 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggtaaagcaactgctgaagcctgccccggctgcagcgggggctgccacatttgttagacatggactttctctctgccctcacccaagcctctcaggtcacatgcagcagggacaccaaggtgacggtagaaacatcaggtcccatttggactgtgcctgtttggggctaggggtttggggtcctggatgtctgggtgcagccatgcagcctggactccctttgtgagcccacacatgccccttccccttgccacgcctggcaggctgtctccttcttttctgatgctgccctccacctgcatctgggaccctctcccttgggtgctgtggctctcccttccttcctgcatcctcatcttgactctcctgggtcactgctgtcggcacacagacatgctgcacaatttctccttttctagaaaagttccttccttaaccccataacaacaactaaccaccccgttgttgcttcccttcatagcagaactcagacctgcctcttcttcccctcccaccattctctcaatccacttctcaggctgacgattctgtctcatcacaaattgttcttgtcaactccaccaccaatttccatcaagccacatctggtcacttgtgactttttttcatgtccttaatgtgcctgctcggtagggtcaaagacagcagtgcgctccctccttgacgcttccttcacttggccttccacccaccatcgtggtttcctcagccttcctggctgctccttcttttctgatgctgccctccacctgcatctgggaccctctcccttgggtgctgtggctctcccttccttcctgcatcctcatcttgactctcctgggtcactg

SEQ ID NO: 326009 - DNA, 855 bp, Homo sapiens
  misc_feature (769)..(769): n is a, c, g, or t
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggaaggtggngcattgagagaagggcatccgagggttagggtgagggtcgcgggttagggatgagggttagggtacgcggttaggtgaagttgtgc

SEQ ID NO: 326010 - DNA, 1095 bp, Homo sapiens
gacggtatcgttaagcttgattaagaaagccggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326011 - DNA, 1918 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcaggtgagtccctcggctactgggtgtgccggggagttgggggactcaacaggtaagctgtcctggggaagcgacaaagaatcttatgcagattggcgggaaaaggaggaaacatgcaccctagtgtggcccctgatggcacatttgatgacctgatatcctaagggggtggcatctgcggaggtggggtgggatgccttctcttggtagatgacatggtattacagataaggtgatgcgactgatttccataaccaaataagtaaatgccatttaggaagggtgagagggcaccgacagttctccgttgtgtgatgtataaattaaggaatggcggagtaggatgtagatgttgaaagataagtgaagagctgttcctgactaataacatgaatgactctggattccaattggtggccatctccctaaacttgagtggggagctgggtccctgcactggaaagtgagaatgaggggagttgctttgttctgtaattctcctgagggaggtgtgggccatgccagattctagcctgtacttttctctacgtggcttacagcgaccttaagttctcccaggcaggatttgtcctggagcagactggcttctgaaggaggggagggaggtgaagctgtctgctcctctcaacctccgctgcctgacccgctgcctttctttcctcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggagaaaaaaaaaaaaaaaaaaaagctctgagagcatcttattttgtttaaaggcaagaaataaaatttccttttgtggagctct

SEQ ID NO: 326012 - DNA, 1352 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctggtaaatcaactttaagttgccgacctctctgggcctcggtacctcagcgttgagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326013 - DNA, 1429 bp, Homo sapiens
aggtttttgtgcattgttgatccttctagatgagagaaactatggagaataatttttggagaaaatgttttcaacaagtgctagagcagcccagcctaatagagttgcagatcccagtggttgtttattactagctaagtgatttgcttttacacatctgcttggcagctggtgcaatgataagttgttaccacaaaataacatggtcctgaattacatggaatttttggggtcactttcgaatggttgaatttgttgatcccaacttagaaggggtcagaaaagagtacctcgggatgattgatccgttttttgtttgtttttaacttggcttttttttgttttttgttttttggtctgggggaagtattcacccagaactcctttaccatgtccacttgtgtttctgccttaccagctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326014 - DNA, 1112 bp, Homo sapiens
  misc_feature (18)..(19): n is a, c, g, or t
  misc_feature (24)..(24): n is a, c, g, or t
  misc_feature (27)..(27): n is a, c, g, or t
  misc_feature (94)..(94): n is a, c, g, or t
attaaggcaggtaccagnnctggngtncgcggcggcgtcggagcatggcggacccccagagctgttttatgacgagacagaagcccggaaatcnttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326015 - DNA, 1102 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326016 - DNA, 1045 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggagaaaaaaaaaaaaaaaaaaaagctctgagagcatcttattttgtttaaaggcaagaaataaaatttccttttgtggagctct

SEQ ID NO: 326017 - DNA, 1042 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggagaaaaaaaaaaaaaaaaaaaagctctgagagcatcttattttgtttaaaggcaagaaataaaatttccttttgtggagctct

SEQ ID NO: 326018 - DNA, 1546 bp, Homo sapiens
  misc_feature (631)..(631): n is a, c, g, or t
  misc_feature (684)..(684): n is a, c, g, or t
  misc_feature (696)..(696): n is a, c, g, or t
  misc_feature (715)..(715): n is a, c, g, or t
  misc_feature (720)..(720): n is a, c, g, or t
  misc_feature (734)..(734): n is a, c, g, or t
aggtttttgtgcattgttgatccttctagatgagagaaactatggagaataatttttggagaaaatgttttcaacaagtgctagagcagcccagcctaatagagttgcagatcccagtggttgtttattactagctaagtgatttgcttttacacatctgcttggcagctggtgcaatgataagttgttaccacaaaataacatggtcctgaattacatggaatttttggggtcactttcgaatggttgaatttgttgatcccaacttagaaggggtcagaaaagagtacctcgggatgattgatccgttttttgtttgtttttaacttggcttttttttgttttttgttttttggtctgggggaagtattcacccagaactcctttaccatgtccacttgtgtttctgccttaccagctcacggatgattgatatccagaccaggatggctgggcgagcattggagcttctttatctgccagagaataagccctgttacctgctggatattggtctgtgcgtcactgtggctgagtggaacgttatctggtcagaatgaatgaggcacatacttgggtggagccatgcgatcatcgatgcctcatggcgcattcgcctaggactgggagngactggtgagaacgcgaagatatgagtcagaaagcggcagcacgctgccatangctagcggcggnactcagtcgtggaccgagnggtcncagtcacccacttnctacagagccgagtgaccactagttatggatgtgtgtgccatcgagcgattctcgtgctgatgcttagtggacatcttgtaatagactaacataggaaggtcttgaatgacctcgtgccaacgtcagccgtgtacgtgctattctcttagcttactcttgtttcactggttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326019 - DNA, 1353 bp, Homo sapiens
tcagtctaaccacattcaggacacttgtttattttaaataaacaggtgaattaagaaaaagttttttaagtctttacctaatcagtctccaggctctctttttggcctgttcctcccttcctcctggccgcctccctcccatgcctctcatgtgcctcctgcagggctgggcccccacttctcttgggacctgtgctttggggcactccccgtcttcacctccttcctttagctccattgatgactttcccccttgctgcttctcccatggctcacctcttgccccctggttcgccactctgccctcactttgtactctttgtagaatcttgagatgactcctcctgtgtccccagccctgctctgcagctgctcctgctttgtgctggctcatcaggctcaggcatccgaatggcagctccttggcttgccctgtctctggtttctacggatggtcacaggggtcttcggggttaccccgccctctttccttcttccctcatacccctcagtccttccttttcagcccctcctttccatccctgtcttcctgcccccaagctgtgggaccctaagctcctgctgtgaactgtcgactgtgctcttgaagtctaggtgatgatgtgtcattgcattggtagaaagcggcctgcttactgctgcttagctgcttcccgaagagggaacagactgctcgctggtgtttaggtctccatgcccggcccagctctctcctcctctgcccacccaacaacctctgtggcccggatggatgttatcaggaaggagggtgtccagagcggggaattgtgttatagggaaggtggagcatttgagagaaggggcatccgaggccaccagactcggaggtaagcttgccatggattcacatgggggccagtcgggcagccccatccatcagctgtccatcagctcatagctgtgtctccgccacaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326020 - DNA, 522 bp, Homo sapiens
ctttgcactttctcctttcaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326021 - DNA, 1000 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326022 - DNA, 1265 bp, Homo sapiens
tcagtctaaccacattcaggacacttgtttattttaaataaacaggtgaattaagaaaaagttttttaagtctttacctaatcagtctccaggctctctttttggcctgttcctcccttcctcctggccgcctccctcccatgcctctcatgtgcctcctgcagggctgggcccccacttctcttgggacctgtgctttggggcactccccgtcttcacctccttcctttagctccattgatgactttcccccttgctgcttctcccatggctcacctcttgccccctggttcgccactctgccctcactttgtactctttgtagaatcttgagatgactcctcctgtgtccccagccctgctctgcagctgctcctgctttgtgctggctcatcaggctcaggcatccgaatggcagctccttggcttgccctgtctctggtttctacggatggtcacaggggtcttcggggttaccccgccctctttccttcttccctcatacccctcagtccttccttttcagcccctcctttccatccctgtcttcctgcccccaagctgtgggaccctaagctcctgctgtgaactgtcgactgtgctcttgaagtctaggtgatgatgtgtcattgcattggtagaaagcggcctgcttactgctgcttagctgcttcccgaagagggaacagactgctcgctggtgtttaggtctccatgcccggcccagctctctcctcctctgcccacccaacaacctctgtggcccggatggatgttatcaggaaggagggtgtccagagcggggaattgtgttatagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326023 - DNA, 419 bp, Homo sapiens
  misc_feature (18)..(19): n is a, c, g, or t
  misc_feature (24)..(24): n is a, c, g, or t
  misc_feature (27)..(27): n is a, c, g, or t
attaaggcaggtaccagnnctggngtncgcggcggcgtcggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctggtaaatcaactttaagttgccgacctctctgggcctcggtacctcagcgttgaggtaggggtgatcgcgcttgctttccgtgggtggttttcaaagtcgaatgtgacaatttgtcctaaacatgtggtaaaagaggcgctgggcggtgggtacgggcgaggggtcagtcctggtg

SEQ ID NO: 326024 - DNA, 254 bp, Homo sapiens
aatgagaggagtcggttggtcgccctgtggccagtcacgtaaaggggggggcggggcggtcgtgggggtggaacatgcgtattactaagcggtcgccgggctgatgacataaaaaccgggtgccggcaggcgccagtcgcaggtgtgctgctgaggcgtgagaatggcgtcccgcggccggcgtccggagcatggcggacccccagagctggtaagtcccggggcccgcggacacccctctccccacttctgcg

SEQ ID NO: 326025 - DNA, 1156 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326026 - DNA, 848 bp, Homo sapiens
  misc_feature (18)..(19): n is a, c, g, or t
  misc_feature (24)..(24): n is a, c, g, or t
  misc_feature (27)..(27): n is a, c, g, or t
attaaggcaggtaccagnnctggngtncgcggcggcgtcggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggagtcagactgaaaccagtaaacgggcggaaggaagccgg

SEQ ID NO: 326027 - DNA, 768 bp, Homo sapiens
tgacataaaaaccgggtgccggcaggcgccagtcgcaggtgtgctgctgaggcgtgagaatggcgtcccgcggccggcgtccggagcatggcggacccccagagctgctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaatctacctctgcttgtttctgggccttcgcctttataccagagggctgagtgaaaatcaggatgatgtgaacccaggagttgtgtcccaatgagaggtccataaggatgcagcggaatgggggaaatcgctggtggggaaaaggggagggc

SEQ ID NO: 326028 - DNA, 1295 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggtaagcttgccatggattcacatgggggccagtcgggcagccccatccatcagctgtccatcagctcatagctgtgtctccgccacaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326029 - DNA, 1331 bp, Homo sapiens
  misc_feature (1262)..(1262): n is a, c, g, or t
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggtaagcttgccatggattcacatgggggccagtcgggcagccccatccatcagctgtccatcagctcatagctgtgtctccgccacaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaagtagctgagactacaggtgcatgccaccatgcctggttaatttttaaaattttnggtagagatgaggtcttcccatgttgttcaggctgatcttgaactcctggcctcaagcaatccccctgc

SEQ ID NO: 326030 - DNA, 1097 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326031 - DNA, 1149 bp, Homo sapiens
  misc_feature (4)..(4): n is a, c, g, or t
gcgnccgacctaccgcacgctgctgcagctcaccaggatcgtaccccggcctgcaggtgtacaccttcacggagcgcatgatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326032 - DNA, 1253 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttggggctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326033 - DNA, 1202 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaagtgaggggagcctgaatactgcggggcgtccgggggtcgggaagcgctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326034 - DNA, 1255 bp, Homo sapiens
  misc_feature (18)..(19): n is a, c, g, or t
  misc_feature (24)..(24): n is a, c, g, or t
  misc_feature (27)..(27): n is a, c, g, or t
attaaggcaggtaccagnnctggngtncgcggcggcgtcggagcatggcggacccccagagctgttttatgacgagacagaagcccggaaatacgttcgcaagtgaggggagcctgaatactgcggggcgtccgggggtcgggaagcggcaagttgcccctgttgctggcgttgcccggaaaggccgtagaatttgggggtgcgggaagggaaggacccgggtgggtgccgatttctgtctctgctcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326035 - DNA, 1059 bp, Homo sapiens
tgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcaggtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326036 - DNA, 1229 bp, Homo sapiens
  misc_feature (18)..(19): n is a, c, g, or t
  misc_feature (24)..(24): n is a, c, g, or t
  misc_feature (27)..(27): n is a, c, g, or t
  misc_feature (94)..(94): n is a, c, g, or t
  misc_feature (314)..(314): n is a, c, g, or t
  misc_feature (367)..(367): n is a, c, g, or t
  misc_feature (379)..(379): n is a, c, g, or t
  misc_feature (398)..(398): n is a, c, g, or t
  misc_feature (403)..(403): n is a, c, g, or t
  misc_feature (417)..(417): n is a, c, g, or t
attaaggcaggtaccagnnctggngtncgcggcggcgtcggagcatggcggacccccagagctgttttatgacgagacagaagcccggaaatcnttcgcaactcacggatgattgatatccagaccaggatggctgggcgagcattggagcttctttatctgccagagaataagccctgttacctgctggatattggtctgtgcgtcactgtggctgagtggaacgttatctggtcagaatgaatgaggcacatacttgggtggagccatgcgatcatcgatgcctcatggcgcattcgcctaggactgggagngactggtgagaacgcgaagatatgagtcagaaagcggcagcacgctgccatangctagcggcggnactcagtcgtggaccgagnggtcncagtcacccacttnctacagagccgagtgaccactagttatggatgtgtgtgccatcgagcgattctcgtgctgatgcttagtggacatcttgtaatagactaacataggaaggtcttgaatgacctcgtgccaacgtcagccgtgtacgtgctattctcttagcttactcttgtttcactggttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326037 - DNA, 554 bp, Homo sapiens
taaccctcaccctaaccgcgtaaccctgaccgtaaccgcgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaagtcaccacgcggttctggaaaggcacttgcctctgcacttttctatattgttcagctgacaaagtagtattttagaaaagttctaaagttataaaaatgttttctgcagtaaaaaaaaagttctctgggccgggcgtggtggctcacacctgtaatcccagcaccttgggaggctgaggtgggaggatcatttgaggccaggagtttgagacctgcctgggcaacataatgaaacttcctttccagggaga

SEQ ID NO: 326038 - DNA, 279 bp, Homo sapiens
ctgctctgcaggtcccagaaaggcgtgtcagttccttctcgtgggactggacctcgtccctgtcggaagggtcaggcctgggtgcctgggcttctggagtggggcagatggtttgagaactctccagggtgacctgagtgcactttggttcctgcaggggctgagtgaaaatcaggatgaagttgaacccagggagtctgtgttcaccaatgagaggtaaagcaactgctgaagcctgccccggctgcagcgggggctgccacatttgttagacatgga

SEQ ID NO: 326039 - DNA, 1004 bp, Homo sapiens
cttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggataaaggccagggatgctgctcaacctcctaccatgtacaggacgtctccccattacaactacccaatccgaagtgtcaactgtgtcaggactaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagacccttcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctaaaaaaatgt

SEQ ID NO: 326040 - DNA, 1669 bp, Homo sapiens
tgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagaagtctctgtctggctttcagcaatgaagggtttggttgtagaagttccaaggcttcccttagcattgatctttgcttcctgaactgcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcga

SEQ ID NO: 326041 - DNA, 1808 bp, Homo sapiens
tgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagatgtcaactgtgtcaggactaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagacccttcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctaaaaaaatgt

SEQ ID NO: 326042 - DNA, 1898 bp, Homo sapiens
tgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagaagtctctgtctggctttcagcaatgaagggtttggttgtagaagttccaaggcttcccttagcattgatctttgcttcctgaactgcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagatgtcaactgtgtcaggactaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagacccttcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctaaaaaaatgt

SEQ ID NO: 326043 - DNA, 217 bp, Homo sapiens
tgacctcatataataagtactgtcattatcccatttcagagatgagtatttgatgctaccttccagactgacagtgtccaggaaagcagctgcagtggaggtggaagggcagtaggattccctgattggtaagggcagtggaatgtcatggggaagactttgtccttgttggtgtcttgggaagagagcagaacagtgccctgtcagccctgcaggt

SEQ ID NO: 326044 - DNA, 434 bp, Homo sapiens
caccgtgggtgtcagggtcatgtgcgtgtgaactgccagccccgtttcgttgtgttactacagagagaaacacagtggaccttctctagcatgagagcaccatagtctaggaggagtgaaggaaggtctttatttcatgagacttaaaaaaaaaatagcttcaagatatagttttagaaacataagcagacatcttgtggtctgacaacaattcataaatcagatcttaaaactgattttagcagatcttttctataaaatgctgtatttataaaatggaaaaaaggcaggatggtgcagcaaattggccaagcacagattgcatattgacttcatctgacacttttttttgtttgtttgtttttgagatgtagtctcgttctgtcacccaggctggagttgcagtggcgcgatctcggctcactgcaacctcc

SEQ ID NO: 326045 - DNA, 1974 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326046 - DNA, 1063 bp, Homo sapiens
  misc_feature (939)..(939): n is a, c, g, or t
  misc_feature (944)..(944): n is a, c, g, or t
  misc_feature (948)..(948): n is a, c, g, or t
  misc_feature (954)..(954): n is a, c, g, or t
  misc_feature (975)..(975): n is a, c, g, or t
  misc_feature (977)..(977): n is a, c, g, or t
  misc_feature (992)..(992): n is a, c, g, or t
  misc_feature (996)..(996): n is a, c, g, or t
  misc_feature (1022)..(1022): n is a, c, g, or t
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagagacagccctntgaantccnaaaagnctcagtcgtcaaaatacaagnanacagaccactacccngccnctgcagattatctccgcgctatgaanctgtgaaaactaaaaaacaaaatatgccttcagacctgagc

SEQ ID NO: 326047 - DNA, 2149 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagggtcaggagtccatgagatgttccctacccatttgaccctccctgccctccagaacatcatttcacgcacagacccagggtctgactgctccactcagtgccacacacccttgctcccctcggggacagggcattttccctgttccctccctgaggtcctgtcctctcccctcagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326048 - DNA, 1915 bp, Homo sapiens
  misc_feature (1)..(1): n is a, c, g, or t
nggcactatgtaggaggcgtctctcggtgttattcgtcacgtgggcgggtgtggtgtacatcttgtgtgactggcctgtcgttcacaccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326049 - DNA, 1949 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326050 - DNA, 1819 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaata

SEQ ID NO: 326051 - DNA, 1494 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttcccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggatatttggtttcagagtaaggactaggtgcaccaccatgactgactatcaatcaaaatgtttgtaacttaaaatttttaatgaaggataatgaata

SEQ ID NO: 326052 - DNA, 1356 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaata

SEQ ID NO: 326053 - DNA, 1444 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagggtcaggagtccatgagatgttccctacccatttgaccctccctgccctccagaacatcatttcacgcacagacccagggtctgactgctccactcagtgccacacacccttgctcccctcggggacagggcattttccctgttccctccctgaggtcctgtcctctcccctcagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatagcccaggaggtcgacgcggccgcgaatttagtagtagtaggcggccgc

SEQ ID NO: 326054 - DNA, 570 bp, Homo sapiens
tcagtttgagagcaggtactgtttattaaccaaccagcttagaaaaataatcatggtagacaccttagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326055 - DNA, 562 bp, Homo sapiens
ccgcagatgagaatggagttagagagacctggtggaaatgagattactcgaggaggctccacctcttatggaaccggatcagagacgggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326056 - DNA, 190 bp, Homo sapiens
ccagctccggcattgtcttcttctccaacccagcacatccagagttccgtgagtgcctcatgggtggggtcagcagggagagccctgtgtctagacaaggcctgggcagagaccctctctccctgactctcctgctctccccaggagtgaacctgaccctgcgatggagcttcagcaatggtacctcatg

SEQ ID NO: 326057 - DNA, 299 bp, Homo sapiens
atactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatt

SEQ ID NO: 326058 - DNA, 1891 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaata

SEQ ID NO: 326059 - DNA, 1857 bp, Homo sapiens
  misc_feature (1835)..(1835): n is a, c, g, or t
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcagtctaaaggaagatgaaactgtctttcaggcgtctccagcanaccctctacagacccgtgttcc

SEQ ID NO: 326060 - DNA, 2026 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccagtgcagaccctgaaccctgtctaatgagacgcattcatgccaactggctatccgtctatgcgccgtcaaacgcagaacatgctcttagcctaatggcccacggaccccagtctgtacgtactgtcatctccctatgtggcaagcccgtgtggaggagcagctcatcggcatgtgaggaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326061 - DNA, 1563 bp, Homo sapiens
ctctctgcaggatcttcattggatagtggatgagggaccaagttcatcgccctgcggaggccatggaccaggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326062 - DNA, 1269 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgagtgaacctgaccctgcgatggagcttcagcaatggtacctcatggcggaaagagacagtccagctatagcccaggaggtcgacgcggccgcgaatttagtagtagtaggcggccgc

SEQ ID NO: 326063 - DNA, 811 bp, Homo sapiens
gagagggtggtctggccacacttagcaatatgggaagacagtattctcagatgaggtggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctg

SEQ ID NO: 326064 - DNA, 1092 bp, Homo sapiens
cgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaata

SEQ ID NO: 326065 - DNA, 5180 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctcttttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 326066 - DNA, 5454 bp, Homo sapiens
  misc_feature (5201)..(5202): n is a, c, g, or t
  misc_feature (5207)..(5207): n is a, c, g, or t
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctcttttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattccccaaaaaaaaaacaacaaaacaannaacanaaacaccaatttcgagcaccctacgcgccccgtaaaaaagcttttaaaacacaaattgatgggcgccacgggcacccacgagagggttaacgacgacacgatgtgatacaaacgaggatccctagagaagaaccccgggagaacaaacaaacaagcgtgggaaactccaccacacaaaaaaaagccgccgggggcacacaccgaggacgttcgcaaaaaacaaccatacgtaattatcaacacgcac

SEQ ID NO: 326067 - DNA, 5594 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctcttttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattccccaaaaaaaaaaaaagaataaataaacaaagaaagaaaatatagaacagtaaataggaacgaaaagaataaaaatcagaagagggggagggcttcaagaaaatatgtctgtactagaggaccacaaaagtggtcgcgagcgccgaaacgcaattatcattaacaagggagggggcacaccacgacaggaagtcatcgaattcaagcagaaagacgggcgccaataaatagagattgaaaacgaagaaacaagggccgaccagtgaaaatagagaagaagaacacatacgagatcgggggagacaatgcggaagaaacgaacccaacgggtaagggcgacaagaagaaccacacccaagggaatagagccaacgaagaaaaataccaggggagaagccaagaggttaagggaatcacg

SEQ ID NO: 326068 - DNA, 3155 bp, Homo sapiens
aatcatcatcattcctttaatagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 326069 - DNA, 5119 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctcttttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagtacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 326070 - DNA, 1286 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggggaatatttgatgagcctacttcgtgtttggagcatcacatgcttttgttataccccatttctcttctattatttgcgagactgattcagagctttctgagatttcaacagtactcactcacctaaagagcctggaatccttgctacatgaagacctaaccacggttcttctcctgtgtctactatctttactccttgtcttctgttcctggaaaaagataaagcaatacaagtgaatcatgactttaaatgaatgaataaaacatcaacaaaaat

SEQ ID NO: 326071 - DNA, 585 bp, Homo sapiens
ccccacttgaaaaataagaatgcttccttgtgctttgctaagatacagcattcaaagaaaaaaagtcataacttaaatctgtaatatgttagctccaatctgagagaacaatgaatcccaatgtctaaaacacattaccattctatatggtgctttgagcttttcttttttaacagaaaagtggtaatgctataggcatattaatgtaggaaaattctatttattttggcttcatacccttctgtgctttgcttcatgtttttaatcggttccaaaatgaatccaagggtttgtgggcatatattataatgtgttcctgctgaaagtcttcttttaacttccacatctgaaataaatcatcatcattcctttaatagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggtgagcactaaacactcggctcaacatccaaatgtaggacaccagacaat

SEQ ID NO: 326072 - DNA, 576 bp, Homo sapiens
tcttctctaaggttaagaatgttgcttctgaagtcctcccaatgaaggatcaactgtgattttcctactttatttccccctacagtagtatggttgcccagtcaaccccataaatatatggctgtgttcttaaagaaatgagactggcagaaatctcataccctcgttctaatgttccctgtaggtgcttcttttaaaacacggttggtagctctgttagcaaacgaccccaccagcaagcccaagtcagtaggaagaagcctgccaattgtgtcattatatttttccgtaagtaattcaagtttgtggaagaaacaagacacttttggtatgttgcaaagggcagccaaagaatgaaaactctgtggccgagcaaacatattacattattctgctgcaacatgtataaagcttctgcaggagattgtttgtatagttgtatatcctgttaaagcagaacttaatgaaagtgttcaactttaacatctctttataagtataacagagtcatgtgcttccatcatcatgccttggacaggtcgggtacatgcaaaggatcacagaaaattgatgagc

SEQ ID NO: 326073 - DNA, 728 bp, Homo sapiens
attgtctactgactccatggatgaattgagtattgtaatgctttatgtatcaataccttttttcaaagtttttcagcttttcacatgtgttcgataacatttaacttttctatggtggattatattaactttttatcataaattttaccatatattttttaaattgtattttaattttaaaaatttgaaaatgcctttttctgttttcttttttagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaactgtaagtatccagggaaaattctttgttatgatgctttataaaaactcatttaacaggtaatgaatatctgtggggttttttggggtttttttttgagacggagtctcactctgttgcccagggtggaatgtagtggtgcaatctcagctcacctcaccctccgcctcccgggttcaagcgattctcctgcctcagcctcctaagtaactgggattacaagcatgcaccaccatgcccggctaatttttgtgtttttagtagagacagggtttcaccatgttggtcaggctggtctcgaactcctgacctcgtgatccgcccgccttggcctcccaaagtgcttggattacaggcgtgagccaccgca

SEQ ID NO: 326074 - DNA, 5268 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgagcctaccttgtacaatgctgtgtgctacatctgtgggtacaaaaagaagtgtggcgtgaatttggtcctcagcaaccacctactctaaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctcttttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 326075 - DNA, 3374 bp, Homo sapiens
caagtcagtaggaagaagcctgccaattgtgtcattatatttttcctgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaaggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 326076 - DNA, 4927 bp, Homo sapiens
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgctgggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctcttttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtgcagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccgtggacctgggccagctctgtgagggctttacccttccacccgaaggacatcatgggggcattcagccactcagaaatgcagatgattaaccaatactgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacggcatttaaagttgtataaaaacacgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttaatttattttagactcaaagaatataatcttgcactactcagttattactgtttgttctcttattccctagtctgtgtggcaaattaaacaatataagaaggaaaaatttgaagtattagacttctaaataaggggtgaaatcatcagaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtagttttttttcatgacaattcaatgactttatctattccatttggatggtacat

SEQ ID NO: 326077 - DNA, 208 bp, Homo sapiens
cccaaattatgaagagaaatttgtagtcctcaagcttcctccattttacccaaacatagactgtgtttgctgtttagagctgagtcctttgtaatctgttttggattttcaccaagtgagcttccttcctttgctctcccatctttctgccttggctactttgagtcagctcactggcttcttgtagccctgttttcctgcatgcaca

SEQ ID NO: 326078 - DNA, 414 bp, Homo sapiens
aattgcccggcatgtacatagtggacccgctctcttcagataggtgcagactatctctgaaagctcactctgcctcagttcctctctaacgatgtgcagcaggtattcaccaagcttccagtagcctgtgtttcacatgatgtgaggtgaaggggtgatggtatatttattggcctcgtatctgatagttgcctgcacattgtgcccagagaagcactttgggaagtggagctggtgttcaaaaggccactaattggcttattccccaggattcatcttcagttgttgaaatctattttttgaaaggcttaacctgggaagtcccctgaaaacaggtgtgtgatgcagtagggacagcgggaaaccaggggaagtttccagagagaagtgtgaagagccattctccattgctat

SEQ ID NO: 326079 - DNA, 342 bp, Homo sapiens
atgtaatctatcacgactttcagtagattctacctcctcgagaatgtggcttgtacatttctccataatttggtgctgctcacctttccagtctcatctctgaccactctgagactctctaaactacttttagtactcacatactcagcatgcataatcattcatgttctttccaaaatgtacgtatgttgtgccctccacccaaaacagacttccccacctctttatttggttaactccttcacaccttgtaagtgtctgtgtacaagtcactaacttccaattttccctaaatctgggttaggttacctcctagggctctcagtacttatctcttcataa

SEQ ID NO: 326080 - DNA, 497 bp, Homo sapiens
ttccctttagataatcaagtaagccattcaaaatgccaaaatgtcccaaactcctaattagctcattagaggtaaacattaattaatcattctggtgagtttaggtaaaggttaccatcttcactgcagggctcctgggaaccctcaatgtaagaaagcattaacccacaaatcagaacattctcaatgaagtccatcaaaaatataaatcaatagaaactgtttttaactcccaactagtgtgctggaagacgaacttgtttaattgtatttgtgtaaaatgttgtagtagtgacacataatgaaatcgttcaagctggtcacccttggagacgccagcagataatacagcaaggcaggtgagatcccaggaagatgttgggttgacagctttgaatcagcacatctttcaactatcatattgcaagataaccacaaccattaatataacaggtatcacttattaatcccttactacatgccaaacactttatata

SEQ ID NO: 326081 - DNA, 1210 bp, Homo sapiens
atggactctctagcaacatcaatcaaccagtttgccctggagttgagcaaaaagctagctgaatctgctcagggtaaaaatatcttcttttcttcctggagcatctcaacttccttgaccatagtgtatttgggcgccaaaggtaccactgcagcccaaatggcccaggtgcttcaatttaacagagaccagggagtcaaatgtgaccctgaaagtgaaaaaaaaaggaaaatggaattcaacttgagcaactcggaagaaatacactctgatttccaaacacttatctcagaaatcctcaagcccaacgatgactacttacttaaaacagccaatgcgatatatggagagaaaacgtatgcatttcacaataaatatttagaagacatgaaaacatattttggtgcagaacctcagcctgttaactttgtggaagcttctgatcaaatcagaaaggacatcaactcttgggttgaaagacagaccgagggtaaaatccagaatctcctgcctgatgactctgtggattccacaaccaggatgattctggtgaacgccctatactttaaaggaatctgggaacatcaattcttagtgcaaaacaccacagaaaagccttttagaataaacgagactacaagcaaaccagtgcaaatgatgtttatgaagaaaaagcttcacatttttcacatagaaaagccaaaagcagtgggccttcaactctactacaaaagccgtgacctcagcctgcttatactactgccagaagacattaatgggctggaacagctggaaaaggccatcacctatgagaagctgaatgagtggaccagtgcagacatgatggagttgtatgaagtgcagctacaccttcccaagttcaagctggaagacagttatgatctcaagtcaaccctgagcagtatggggatgagtgatgccttcagccaaagcaaagctgatttctcaggaatgtcttcagcaagaaacctatttttgtccaatgttttccataaggcttttgtggaaataaatgaacaaggtactgaagctgcagctggcagtgggagtgagatagatatacgaattagagtcccatccattgaattcaatgcaaatcacccattcctcttcttcatcaggcacaataaaaccaacaccattcttttttatggaagattatgctccccctaatcctgcatatctctca

SEQ ID NO: 326082 - DNA, 960 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326083 - DNA, 611 bp, Homo sapiens
gatctctttggggtcaagaaagaaccctagtggatttgggattctagagggggtgttataattaattattcagaaaaatgcatgtatttacctcttcaaccaaaagggcagtgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326084 - DNA, 716 bp, Homo sapiens
ggtatccacgcgacccccttcaaactctttcttgaagcaccaacatgctgttggtcacctggtagtttcttttctcagataatgtatgtccatcagtcctcaccatagagtcgtgtcctttcctcacagtaccggaggcaatcaaatagaactgtcactcaagggtcgtgtcacaggaaggaccgcccaccacgtctccctcgcatgaattttctttgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326085 - DNA, 594 bp, Homo sapiens
actctccaatagagattacaatagagatctccaacatgatttcgatgcatttagaggagaaatatttcctggttaagtggaaaattgtgcggattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326086 - DNA, 571 bp, Homo sapiens
  misc_feature (32)..(32): n is a, c, g, or t
cttgaacccccattgaacgcttgagcgccatngtgagggtacctggccattcggccattatggccggggagtgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326087 - DNA, 612 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaacaagttatccagcggccgaattgagctcattggccaatcccccttcg

SEQ ID NO: 326088 - DNA, 757 bp, Homo sapiens
  misc_feature (572)..(572): n is a, c, g, or t
  misc_feature (638)..(638): n is a, c, g, or t
  misc_feature (664)..(664): n is a, c, g, or t
  misc_feature (666)..(666): n is a, c, g, or t
  misc_feature (681)..(681): n is a, c, g, or t
  misc_feature (686)..(686): n is a, c, g, or t
  misc_feature (693)..(694): n is a, c, g, or t
  misc_feature (700)..(701): n is a, c, g, or t
  misc_feature (706)..(706): n is a, c, g, or t
  misc_feature (715)..(715): n is a, c, g, or t
  misc_feature (719)..(719): n is a, c, g, or t
  misc_feature (728)..(728): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttcgactttagactcgngcaagtttatgcatgcggccgaatttcgggctaacttggccaattcgccctatagggagccggatnaccattcactgcccgcgttttacacngngggactggaaaaccntgggntacccanntaaatnncttgnagcatcccntttnccagttggnttatactggcctgaccgtcgccctttcct

SEQ ID NO: 326089 - DNA, 823 bp, Homo sapiens
  misc_feature (32)..(32): n is a, c, g, or t
  misc_feature (576)..(576): n is a, c, g, or t
  misc_feature (638)..(638): n is a, c, g, or t
  misc_feature (704)..(704): n is a, c, g, or t
  misc_feature (730)..(730): n is a, c, g, or t
  misc_feature (732)..(732): n is a, c, g, or t
  misc_feature (747)..(747): n is a, c, g, or t
  misc_feature (752)..(752): n is a, c, g, or t
  misc_feature (759)..(760): n is a, c, g, or t
  misc_feature (766)..(767): n is a, c, g, or t
  misc_feature (772)..(772): n is a, c, g, or t
  misc_feature (781)..(781): n is a, c, g, or t
  misc_feature (785)..(785): n is a, c, g, or t
  misc_feature (794)..(794): n is a, c, g, or t
cttgaacccccattgaacgcttgagcgccatngtgagggtacctggccattcggccattatggccggggagtgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaanaaaacttcacatataaataataaacatgttggccgcctgggcccagacgactttagactcgngcaagtttatgcatgcggccgaatttcgggctaacttggccaattcgccctatagggagccggatnaccattcactgcccgcgttttacacngngggactggaaaaccntgggntacccanntaaatnncttgnagcatcccntttnccagttggnttatactggcctgaccgtcgccctttcct

SEQ ID NO: 326090 - DNA, 503 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttcctgcatgaaatcatgttggagatctctattgtaatctctattggagattacaatgattaaatcaataaataactgaaactt

SEQ ID NO: 326091 - DNA, 553 bp, Homo sapiens
gttataagaaatcttacctcaatgtaagatctactttatttaaattttaagacaaaacagtccaataacagtttgagacttggaaatcaatgtgcagaaactactgtaatctctcgttggccagtgttttaagtatttgaagatggttattctattttgtgtttggtttagttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326092 - DNA, 437 bp, Homo sapiens
  misc_feature (37)..(37): n is a, c, g, or t
tacattttattcaaatttgaatgcccgatttcccagncagagagaaagagttttattgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326093 - DNA, 573 bp, Homo sapiens
cacttgggacgtccgtacatgtctcatagcgaataaggttcataggcttagggcctgggggatacgttggcgcgattgatctcctggctccgagtcgctagaaccctctggccgaaagaccattgctgccgccacgatcatcggttgcaggccatcgaaggattgtcccgtatgcttgtgagtccctccatcttgttgtcatatcatgggaagagtgcagcgtgcatggccgcaactacatgtatctcttggggtctgcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326094 - DNA, 411 bp, Homo sapiens
  misc_feature (305)..(306): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgtatgggacagaaataacccagagccctggaacaaactgggnngtcccaatgggactcaataccaagggttctactaaagggggggggcccccccctttttttggggggggacaaaaaaaaaagggggcgcaaatgaaggtcttccag

SEQ ID NO: 326095 - DNA, 545 bp, Homo sapiens
tcatggttctcggcacatgtaaatgttttttgccttcacttgcacatttgcagttgaaaaacaatagacaatcaaaagattgattcatcattattctatgcacttttctgtatatcactttattaattaaatggaaaggttttgtgaaagccagataaaaagtatcttgtgatagggattctgtgttctaccttttttctaattgattacatgagattgcttattatagatcctctacctgtttcaacttcataatgaaataacaccatacctcatctaatagaaaataagattgatctgttcaaaaatgtattcttagtacaaaacactaaatagtgctttattattataacagtcgtaatgttttatttcttttagttgggacagaaataacccagagccctggaacaaactgggtcccaatgatcaatacaaggtaaactacaaaattgttttaaagttgttagaaattgtgttgtaataagttttgtcatggggtgggttttcttgaaactggatatacgagtaaaattccattatattga

SEQ ID NO: 326096 - DNA, 1014 bp, Homo sapiens
gatctctttggggtcaagaaagaaccctagtggatttgggattctagagggggtgttataattaattattcagaaaaatgcatgtatttacctcttcaaccaaaagggcagtgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326097 - DNA, 816 bp, Homo sapiens
  misc_feature (587)..(587): n is a, c, g, or t
  misc_feature (589)..(589): n is a, c, g, or t
  misc_feature (598)..(598): n is a, c, g, or t
  misc_feature (606)..(606): n is a, c, g, or t
  misc_feature (613)..(613): n is a, c, g, or t
  misc_feature (616)..(616): n is a, c, g, or t
  misc_feature (631)..(631): n is a, c, g, or t
  misc_feature (697)..(697): n is a, c, g, or t
  misc_feature (723)..(723): n is a, c, g, or t
  misc_feature (725)..(725): n is a, c, g, or t
  misc_feature (740)..(740): n is a, c, g, or t
  misc_feature (745)..(745): n is a, c, g, or t
  misc_feature (752)..(753): n is a, c, g, or t
  misc_feature (759)..(760): n is a, c, g, or t
  misc_feature (765)..(765): n is a, c, g, or t
  misc_feature (774)..(774): n is a, c, g, or t
  misc_feature (778)..(778): n is a, c, g, or t
  misc_feature (787)..(787): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaaaaaaaaaaaaaaaatacananaaaacatgncgcccgcntggcccnagncgactttagactcgngcaagtttatgcatgcggccgaatttcgggctaacttggccaattcgccctatagggagccggatnaccattcactgcccgcgttttacacngngggactggaaaaccntgggntacccanntaaatnncttgnagcatcccntttnccagttggnttatactggcctgaccgtcgccctttcct

SEQ ID NO: 326098 - DNA, 723 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaaatatggatttacacatctctcaactggacgagctctgcgtgaggaacttgcatcagaatctgaaagaagcttgatcagagacattatggaacgtggagacctgatgccctcatgcaatcgtttggagcttctgggaggccatggtggccagcctc

SEQ ID NO: 326099 - DNA, 747 bp, Homo sapiens
  misc_feature (558)..(558): n is a, c, g, or t
  misc_feature (578)..(578): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttnaaaaaaaaatgctataaatnattgaaataaaaaataatttttaatagaaaaatttggggcgcccctgggcccagtgcttttttgattgggaaagatttttctttggcgcccaatttggggctctttggcaaattccccatatggggggggtaaaaacaatctggggccgggtttaaaacgggggagggg

SEQ ID NO: 326100 - DNA, 714 bp, Homo sapiens
  misc_feature (655)..(655): n is a, c, g, or t
  misc_feature (677)..(678): n is a, c, g, or t
  misc_feature (680)..(680): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaacaacaaaaacaaaaaaaaaaaaaaaaaaaaaaaaatttgttggggcggccttgggccctggaaaaagttttttaaccccttctgttngggggccgggccccattgggtnngngcacctgtgccaaaggcggtccccaggaaaatcc

SEQ ID NO: 326101 - DNA, 1074 bp, Homo sapiens
tcatggttctcggcacatgtaaatgttttttgccttcacttgcacatttgcagttgaaaaacaatagacaatcaaaagattgattcatcattattctatgcacttttctgtatatcactttattaattaaatggaaaggttttgtgaaagccagataaaaagtatcttgtgatagggattctgtgttctaccttttttctaattgattacatgagattgcttattatagatcctctacctgtttcaacttcataatgaaataacaccatacctcatctaatagaaaataagattgatctgttcaaaaatgtattcttagtacaaaacactaaatagtgctttattattataacagtcgtaatgttttatttcttttagttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326102 - DNA, 1050 bp, Homo sapiens
ctgaggcgggtggatcacttgaggttgggagttcgagaccagcctgcccaacatgatgaaaccccgtgtctactaaaaatacaaaaattagctgggcgtggtggcacatacctgtaattccagctacttgggaggctgaggcaggagaatcacttgaacctgggaggcagaggttgcagtgagctccagcctgggtgacaagagtgaaactccgtctcaaaaaaaaaaaaaaaaaatgcagataatttttagcttagggcctggtggctaggtcggttctctcctttccagtcggagacctctgccgcaaacatgctccgccagatcatcggtcaggccaagaagcatccgagcttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326103 - DNA, 969 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgtatgggacagaaataacccagagccctggaacaaactgggaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326104 - DNA, 1288 bp, Homo sapiens
aatattaattgattataaagaaatgttggaaatgtaaacagcaaaaataccgtattatttaaaagccattaccagagttgaagtgtcagtttgatattgaatatagtctggattaggaaattagtgagagagagaaaatatcttagaagttatgtaaaccacaaaacaaagcagtaccttatattactagcctctttttgttgcaggatctctccctctaaattacagcagttcattcagcaagtagggaaggtaattcttgttaatcctctattctgttggcgattcttccacgtacttagtagagttaaggcaaaaacttaccgaattggaagtatgtatcagaaggaattcttaattattcactttgaaataaaagaattttccttataggttccaagtagtagactgtactataatactgctcttctgaaataaattgaatatttttaccttgccaaaactatcattgaaggctggaattttaggtacagtatttttctgtgaatgattttatgttgttaaatattcttttaaaaattcatatctgtaattgttactgtagaaaaccaaatacaaagaattctaaaacctttgtaccgtctctatgtatttgagattacttaaaatatctttttttctgttccaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326105 - DNA, 1010 bp, Homo sapiens
  misc_feature (222)..(222): n is a, c, g, or t
  misc_feature (227)..(228): n is a, c, g, or t
  misc_feature (271)..(271): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagaccntgggnntaaatttccttacattgtgacccggattccatggaggccaacntttttggctttcaaaaatcgccaagcatagtttgtatgggacagaaataacccagagccctggaacaaactgggaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatg

SEQ ID NO: 326106 - DNA, 647 bp, Homo sapiens
ctgaggcgggtggatcacttgaggttgggagttcgagaccagcctgcccaacatgatgaaaccccgtgtctactaaaaatacaaaaattagctgggcgtggtggcacatacctgtaattccagctacttgggaggctgaggcaggagaatcacttgaacctgggaggcagaggttgcagtgagctccagcctgggtgacaagagtgaaactccgtctcaaaaaaaaaaaaaaaaaatgcagataatttttagcttagggcctggtggctaggtcggttctctcctttccagtcggagacctctgccgcaaacatgctccgccagatcatcggtcaggccaagaagcatccgagcttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326107 - DNA, 957 bp, Homo sapiens
ctgaggcgggtggatcacttgaggttgggagttcgagaccagcctgcccaacatgatgaaaccccgtgtctactaaaaatacaaaaattagctgggcgtggtggcacatacctgtaattccagctacttgggaggctgaggcaggagaatcacttgaacctgggaggcagaggttgcagtgagctccagcctgggtgacaagagtgaaactccgtctcaaaaaaaaaaaaaaaaaatgcagataatttttagcttagggcctggtggctaggtcggttctctcctttccagtcggagacctctgccgcaaacatgctccgccagatcatcggtcaggccaagaagcatccgagcttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaacaattcacgaaaaaagcgatcataacaaaagcaaaactaccacaggaaaaaaaaaaaaaaacttgttggcccctttgggccaaatcaattttagcttgggcaaggttttgcatgggggccaaatttggggtcaattgggcaatttccccctatggggaggctgttaaaaatacatggcccgggttttacaacgttgggctggaaaaacctctgggttccccaatttaacgcctttggagtacccctttttccaaggtggcgtataacccaaggggccctccgcggcttttccggtggct

SEQ ID NO: 326108 - DNA, 429 bp, Homo sapiens
  misc_feature (91)..(91): n is a, c, g, or t
ggagaatcagatatgaagattatccgtgtcctctggtggtactacttctccaaactcatagaatttatggacactttcttcttcatcctgngcaagaacaaccaccagatcacggtcctgcacgtctaccaccatgcctcgatgctgaacatctggtggtttgtgataaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326109 - DNA, 733 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaacctctcctaaataaaaaaaccattgtggcccgcctgggcccagccgatcttagacttgggcaggcttatgcatcgggcccgaatttcgggctcattgggccaattcgcccttatagcgggcgcaattaccaattaccgggcccggggtcttaaccaggtcggaattgg

SEQ ID NO: 326110 - DNA, 766 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaaaaaaaaaaaaaaaacactcgacactagttctctctctctcctagggccagtgtcactcagggggcttgtccatctctctggggggcgcgacagcttggaaaagccgaacggataagagacaaggaggtgagaaggacctgttcaacacaagaggccctgaggagctcagataacgggataagccgtagtgcacagaag

SEQ ID NO: 326111 - DNA, 870 bp, Homo sapiens
  misc_feature (647)..(647): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaaaaaaaaaaaaaaaaagagtgtgtggggcggtggggcccgagagaaagtttttggaaacctttgggtggggggggggggncccaggggtagtgcagcctggggccatagcggtgacccccacagaggaaaaaccccggggcagaaacacacaagggggcggggggatcctcccccagataaaataaaacgccggggggggcacacagaggggtggctgaacacaacccccgaagggaggccccagaagcgccaactacgggcagctacaaaacggggagctcacaaggaagccggatacaatc

SEQ ID NO: 326112 - DNA, 777 bp, Homo sapiens
  misc_feature (588)..(588): n is a, c, g, or t
  misc_feature (604)..(604): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaccaaaaaactctaagcctaancaaatttaaacctgcncacacaaaaaaaacccattggcaacttgggccaaggccagttaaaactcaactcagttttcgcaggagttcaacattcgggcctaattgccctttacggcgcaaaaggcccttttttcgagtcattgcccgtttttgacacgggcttacgggcccctggccccggcgtttccc

SEQ ID NO: 326113 - DNA, 693 bp, Homo sapiens
  misc_feature (634)..(634): n is a, c, g, or t
  misc_feature (656)..(657): n is a, c, g, or t
  misc_feature (659)..(659): n is a, c, g, or t
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttaaaaaaaaaaaaaaaaaaaaaaaaatttgttggggcggccttgggccctggaaaaagttttttaaccccttctgttngggggccgggccccattgggtnngngcacctgtgccaaaggcggtccccaggaaaatcc

SEQ ID NO: 326114 - DNA, 557 bp, Homo sapiens
caagggtccttcgaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaactt

SEQ ID NO: 326115 - DNA, 422 bp, Homo sapiens
gctagagtgcagtggcacgatcttggcttactgcaacctccgcctcccgggttcgagcaattctcctgctttggccacccaagtagctgggattgcaggcgtgcaccaccacacctaagttttgtgtttttagtagagacaaggtttcactatgttggccaggctcgaactcctgatctcaaatgatctccctgcctcagcctcgtgcctgtaatcactctgggattacaggcgtgagccaccacgcccggcggtcaacatggagtgctttaatcatgacacgtgggagatttttttatcctcatattcaccttggtaaatcctactcatatttgaactcttaatataagcactacttcctaagggaagtccttaagattacccatagaaggtactttattaaatatttgttggataaatga

SEQ ID NO: 326116 - DNA, 717 bp, Homo sapiens
tttgtttttaaggtggattcttattatgttgccccagttggagtgcaatggctattcacaggcacaattgtagctccctacagcctagaacttctgggctccagtgatcctcctgccttagcctctggagtagctgggacaacagacatacaccgtcatgcctggcctaacttcagaaattcatttcacctatcatcaataccacatacaacattttttttacttctatatactctactgccaaaaaaaattttaaaaagaaagaaagaaaaagaaaacatggaaacaagtgacaagaaatataaatttaacttagcaactatttcatttttggtagtctgctgtctgacagttttagcaatcctgttaattacaagaaagcaaaggcatgaagaaaaatacctactcttcccctcaaacaaaatcgtctggaccatgccctgggagaagcactcaggttgttattctagtccaaagcaatgagaaataaagaagaataaagaacaaaggaagtatttaagtgtattcagttgttattaaagatgaagcagaaagcaaattaaaccaataggacataaccaaaaagccaagagaagaaaaagcagttcaaaaacactagctttgggcactttgacatctccccaaacacctgcttattaaagtcctaggactccacccttttatttctaaataaaatcacaaaagtcttccagagaa

SEQ ID NO: 326117 - DNA, 657 bp, Homo sapiens
ggaaagaccaggtgtgactttctccaaaactgagtgattgcttgtggatgaatacaatctaaaaatacaaggccatgaagtagtttttcatttagatgctgagaaataataggtttgggcagctcaaagcataggaaatagtaagggttttctagagctcctcctttggtggcctgtttgagtagcacaagggacgtcatcctaaatgtgcagttgccatttgttctgtagtgacttacagggatctcagtggcaaagggcgtcagtgagacaacaactgagcaaaaagaactagacgaggcttgcgcttggaaagtcacggtaggattggacctgccggccacatggctcagggagtattgacggatttgcacattggcaggaaactctcccgtttgggattctttaaatggggcacagaaggccacttgtttgcatttctgggtaaaaaacagtcatcccccatgactgcctgcatcgggtttgtcttgtgccaaagttactcttcctttgtttttactttgccttgatttttagcattagctggtagtttggcttggaaatgtcctggatagccgattccctaagaaactgaaacatttaatattggcttaggatgtatcagatggggccaaataaagcttctttacaatagta

SEQ ID NO: 326118 - DNA, 1398 bp, Homo sapiens
ggaaagaccaggtgtgactttctccaaaactgagtgattgcttgtggatgaatacaatctaaaaatacaaggccatgaagtagtttttcatttagatgctgagaaataataggtttgggcagctcaaagcataggaaatagtaagggttttctagagctcctcctttggtggcctgtttgagtagcacaagggacgtcatcctaaatgtgcagttgccatttgttctgtagtgacttacagggatctcagtggcaaagggcgtcagtgagacaacaactgagcaaaaagaactagacgaggcttgcgcttggaaagtcacggtaggattggacctgccggccacatggctcagggagtattgacggatttgcacattggcaggaaactctcccgtttgggattctttaaatggggcacagaaggccacttgtttgcatttctgggtaaaaaacagtcatcccccatgactgcctgcatcgggtttgtcttgtgccaaagttactcttcctttgtttttactttgccttgatttttagcattagctggtagtttggcttggaaatgtcctggatagccgattccctaagaaactgaaacatttaatattggcttaggatgtatcagatggggccaaataaagcttctttacaatagtaaaagcactttatacttcactctctgagtcttcccaataaataaccttgggaggtgcagggggtggggggcccaggatggggaggcctgggagctcccagggtagtgacagagttgggctgagttctccagacgccaggatgcgtcgcagcggggccagctcaggagtgctcactcccagccctctggatctctctcctggttggaataatcattacatatcgtaactctcaaaatttattcacttatattttcagaataagaagtgtgaaatgttaacagctctctgctctcttacttgttccccatttggggatcttctggagggaaggggcagggggagagtaacttttctatatccttggtttctaggaacacatcgatttgaagactcagtagctgactggtttttttttttcccccttcaaactgaagtgcgagtgtgcgtgtgttccacaaaatagcaagtatttatagtgttgtaattacatttccttgagaaatattttcttgtatttaaaaatctttctacttcagtaactcccagcagaacagtgcccaggacagcatgtgccggttagtaccagctttgcaggtgagctgacttctaaacttaggacgacgtcttcatcaatcaaactagtgcacagtccagaaaaaggggtcctttatcttctaagttctgctcctcacctttctttggaaccaaaattgcagtggagtgtgaggaagagctttgaaag

SEQ ID NO: 326119 - DNA, 5837 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccac

SEQ ID NO: 326120 - DNA, 374 bp, Homo sapiens
aatgcaactcatcgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattccc

SEQ ID NO: 326121 - DNA, 2765 bp, Homo sapiens
attcatttgggatctggaacttgtcactgtcccactgctgcctcgtgggctcttaggtcttttgtggggggatgggaggggtgttctgaagatcatgtttttgaagaaaagtactttaatttttgccaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggagttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326122 - DNA, 6321 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggtagggcaggccctgctaacttttctcactacttggaaaaggggtaagggaggctgagtcatgtaccctggaggttcaggcttcggttacgggcagcccctctggatcctgaaactctgccctgctctgtaggcagaaaagggaagatgcttgagctgatcccctaggtatagcttctgaaggtctggcttcttgctagatttgctgacctagactccatgctgctcatcctacccccttgcccatgtcctccctgtccacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326123 - DNA, 3267 bp, Homo sapiens
cattcattggtggttccatggtagaacgcatgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326124 - DNA, 5672 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326125 - DNA, 2589 bp, Homo sapiens
caatggggaacctgtgcatggcctggtgcacacggagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326126 - DNA, 1873 bp, Homo sapiens
actagacgatcccgttctagccgcgccagtgtaggcccctaaaccagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326127 - DNA, 6116 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcaggggctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggtagggcaggccctgctaacttttctcactacttggaaaaggggtaagggaggctgagtcatgtaccctggaggttcaggcttcggttacgggcagcccctctggatcctgaaactctgccctgctctgtaggcagaaaagggaagatgcttgagctgatcccctaggtatagcttctgaaggtctggcttcttgctagatttgctgacctagactccatgctgctcatcctacccccttgcccatgtcctccctgtccacaggcagtgcctatgaggtgaagcagcacccattctttactggtctggactggacaggacttctccgccagaaggctgaatttattcctcagttggagtcagaggatgatactagctattttgacagtaaggccaccgatgggtggggtggaggatgggtcctacctgtttgcctagaaacacctgtgcacactgaaattgcattgggagcaacttctcagggctctgctgaaatctaatggggtcacaaggaggccaccagcagggctctgaaggaaagtgtcctttatgtctggcccagcccgctcagagcgataccaccacatggactcggaggatgaggaagaagtgagtgaggatggctgccttgagatccgccagttctcttcctgctctccaaggttcaacaaggtgtgactgaggaggcccagaatgggcagaacaggctggaggatcagaagaagagggcctgtcaaagggcacacctggggcaggctcagggagttggggttggggccacctctagaaaaagaggagctaagggttggggctacatatagctatatataggtgcttctagaaccactgctgtccctgacatgagatgccaggtcagatcagtggaataactccttccccaaatattcagcaggggtgtgtgaaggagggatggaaccgactggttcaaattcctaggtttccgatgccaaggatgctttatgccacttgggaggtacggctgccagagcccatccccagcgcatcccctgtgcccacaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatgatgtgagcacccagagttcacccagggtgggcgacacagctatccctgcattgtcacagatcatgggagagattccgatgccagggaggagtgcaggtggcagggagggggcattcacaagggtggctcctggaggaatgtctgcggaggaaagttctgttactataacccttgtgtgcccctaaggagacctggcaggaggagggggaccacctgggtcactcaccccaggccttgtgtctcatagattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccaggtatggcccagtgggcggccaaacgacctaagctggaggatactgcagggcagggaggctcagcggcatcgcgggtctcactgcttacttgggcctacagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcgggtgaggcccctggggagctgggataaaactcacaggaagggccttgtaatctctaggccttgggagggttctgcacgtggcaggtgtgtgtgtgtgtgttaagcacagatctgactgtggtctctgaaggtgtgtattggtgtctggggttgtgtatacatgtgccagaaagcaggacagcaccatgtcacaagtgcaggctttggggtagagagctcacactcaaatcctggctccatcactaacaggctcttgaccttgagcaagttgcttaacttctctaagcctcaagtttcttatccaaaaatgtggatataatagaggccagctgataggttgtgacatttaaatatatatgacaagcttatatagtccctgatacacacataaatgctagctgccatttctcatcaccaccaccgtctcttggggtctggacacgggagagggcttcacaggtcaggggctgtggggaaaatggacctaggctcaggctctgtctgtgactagagttgtgctgacatcaacagactggaccaggggccaggccaaagccctctgacccactaagtcctggcttctccttctccagaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtgggtatgtctgaccatccagacctgctgtctccctgcttcatcatccttccagcttcccctttgtggagcccatctgtccctgctcgggggtcaaagggtggtggtgaaggggctcacagcttaatgtccagaaccaggccccatacttcgtgttcaggctccagtctgagtactgttctcttcctggcacagcacgtggaggatggaggtccggccagtgaggcagggcttcgtcaaggtgacctcatcacccatgtcaatggggaacctgtgcatggcctggtgcacacggaggtggtggagctgatcctgaaggttagtgctgggcgtgctgcctgcatggtccctgaat

SEQ ID NO: 326128 - DNA, 320 bp, Homo sapiens
ggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgag

SEQ ID NO: 326129 - DNA, 5736 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326130 - DNA, 6007 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggtacgaagggctccctgcagatcagtgacaacccctgggaaataggaaagttcctaggccctgtgtgcttctgacagatcccactctgagtctctcatttagcccaccccctgaaagatcctgtagtcttggggaggaattaattgatggggaagggggtagcttggtttctgggacataacagggctaagccctgtcttgcccttgagtcacttctaacagctaacactgctctgcttttgtctgtctgtctgtctgtctctgtacaaagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326131 - DNA, 6328 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcgggtgaggcccctggggagctgggataaaactcacaggaagggccttgtaatctctaggccttgggagggttctgcacgtggcaggtgtgtgtgtgtgtgttaagcacagatctgactgtggtctctgaaggtgtgtattggtgtctggggttgtgtatacatgtgccagaaagcaggacagcaccatgtcacaagtgcaggctttggggtagagagctcacactcaaatcctggctccatcactaacaggctcttgaccttgagcaagttgcttaacttctctaagcctcaagtttcttatccaaaaatgtggatataatagaggccagctgataggttgtgacatttaaatatatatgacaagcttatatagtccctgatacacacataaatgctagctgccatttctcatcaccaccaccgtctcttggggtctggacacgggagagggcttcacaggtcaggggctgtggggaaaatggacctaggctcaggctctgtctgtgactagagttgtgctgacatcaacagactggaccaggggccaggccaaagccctctgacccactaagtcctggcttctccttctccagaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326132 - DNA, 5447 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaacca

SEQ ID NO: 326133 - DNA, 5765 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaagggggagactgtgccactctgctgaagaatattggggccctgcctgtggacatggtgcgtctatactttgcggaaactgtgctggccctggagtacttacacaactatggcatcgtgcaccgtgacctcaagcctgacaacctcctaattacatccatggggcacatcaagctcacggactttggactgtccaaaatgggcctcatgagtctgacaacgaacttgtatgagggtcatattgaaaaggatgcccgggaattcctggacaagcaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtgatgagattgtgtggcctgagggtgatgaggcactgcccccagacgcccaggacctcacctccaaactgctccaccagaaccctctggagagacttggcacaggcagtgcctatgaggtgaagcagcacccattctttactggtctggactggacaggacttctccgccagaaggctgaatttattcctcagttggagtcagaggatgatactagctattttgacacccgctcagagcgataccaccacatggactcggaggatgaggaagaagtgagtgaggatggctgccttgagatccgccagttctcttcctgctctccaaggttcaacaaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatattacggaagcggctgtcggtgtctgagtcgtcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcggaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtggcacgtggaggatggaggtccggccagtgaggcagggcttcgtcaaggtgacctcatcacccatgtcaatggggaacctgtgcatggcctggtgcacacggaggtggtggagctgatcctgaagagtggaaacaaggtggccatttcaacaactcccctggagaacacatccattaaagtggggccagctcggaagggcagctacaaggccaagatggcccgaaggagcaagaggagccgcggcaaggatgggcaagaaagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcagtgggagggaattcatcacagagcagctcccccagctccagcgtgcccagttccccagccggctctgggcacacacggcccagctccctccacggtctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacttctcgcaagcacagccttgacctgccccactctgaactaaagaaggaactgccgcccagggaagtgagccctctggaggtagttggagccaggagtgtgctgtctggcaagggggccctgccagggaagggggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagaccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccacagaccccatccctcctgaaggttgctggaaggcccagcacctccacacccaggcactaacagcactttctcccagcacttcgggactcacccccaccagcagttgctctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtctgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccaaaaaaagtcgacggcggccgcaattttag

SEQ ID NO: 326134 - DNA, 2771 bp, Homo sapiens
taggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctgaaggagttgagccttccaagaagaggcagcttttgtcggacaagtaaccgcaagagcttgattgtgacctctagcacatcacctacactaccacggccacactcaccactccatggccacacaggtaacagtcctttggacagcccccggaatttctctccaaatgcacctgctcacttttcttttgttcctgcccgtaggactgatgggcggcgctggtctttggcctctttgccctcttcaggatatggaactaacactcctagctccactgtctcatcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcagtcccggacgatccccagtatcctttgacagtgaaataataatgatgaatcatgtttacaaagaaagattcccaaaggctcatgagcgctcagagagctcagaagtggcttttgtgatgcagctggtgaaaaagctgatgattatcattgcccgcccagcacgtctcctggaatgcctggagtttgaccctgaagagttctaccaccttttagaagcagctgagggccacgccaaagagggacaagggattaaatgtgacattccccgctacatcgttagccagctgggcctcacccgggatcccctagaagaaatggcccagttgagcagctgtgacagtcctgacactccagagacagatgattctattgagggccatggggcatctctgccatctaaaaagacaccctctgaagaggacttcgagaccattaagctcatcagcaatggcgcctatggggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctctgagaatagaacagaagagcaacatggggcatagttctggagggaggcagcagctttgccagtttcccttccctctcaccttctcactgtgtgtacagcctccaaagatactgtgcctagtcttgaagctgaagctgaacaaaactgtcctttagtgtttactgggtacatgctgggagttcatagtgttactttactcagaaactaaaagccagtaagaaggaagtaacatgaacagatgttaacatctcagccagatgtgtttacagtatgcagtattcctgtcctaaaaaacattaggctggtacaaaagtaattgcatgtttgccattacttttaataaaggcctgggttccttccctctctggcctgaaaaatgtccatgacagctattagcagattcactttactttccacccccctccataccctgtgtattttcatgctgctaataaaggcataccagagactgggcaatttacaaaagaa

SEQ ID NO: 326135 - DNA, 178 bp, Homo sapiens
atagcaggaccctgtgtctacaaaaattacaaaagtaaatctcacgtggtggtgcacatttgtggtcttagctgcttgagaggctcccttgagcccaggagtttaaggctgcagtgaggtatgattgagcccctgcattccagcttgggcaacagagcaaggccctgctctttaaaaa

SEQ ID NO: 326136 - DNA, 713 bp, Homo sapiens
tttctcccacctgtaaagtggggatgacaatactctccacctacctacctcacaggggtgttgtggggattcatgtggtaacattcgtacggcgctttaaacctcttagaagtggtgcgacataaacacagcattttattctttattgcacttcatgcatgtgaagatttgagggcaaaggaattccatatccaggcaaccaccaccacagtcacctgcaaaagctgagcagatgaaatacacacaaaggtacacttaggactttgtcatgattcctttctgtaatcttggctgaatcaaaatcttttgttcaaagaacattggaaatgtttttacaaattatcgacagctacaaacagtcttcaattctaccatgtatttgcagaaaagtggttctttcattgcctgaactcaccctggcatgttctgtgttgactccagagtgttacgttgcctatgtttgatttatttgagaagaataaatctcaggtatatggcaggtttcatagagttgaagggaaagtatttcattgatttttataagcagaagcctgccaacttgtaatgtctttttgaaaacaaaccttgcaaagatgtattgaaaagatgaagtagcaagaggatacttgtatcaaagcactctgtgcagtgttagactatatgcagttttattaatgcaacttttctggtgttttcagccactgcccagtgag

SEQ ID NO: 326137 - DNA, 718 bp, Homo sapiens
caacaaaatcacaatctgtctcgattactcatttattcaacccgcattcacctactgtgtgcacgagcttttctagggcactggggaggcagaagggactaaaacaaagtataaatctccctgggctgcaagcctcgggagggcaggtccgggggctctgtgtccccactgggcccccagcactgcgcagcgcacacagtgggcgctcaccaagcgctcgctaagggcaacgcgtgaatccgtgtcccgccagcagggcgtttacggcctggtggggcggaaacggacccgacaccaccgcggcgtcctggggcttctgggaatcccatcagcgcggccagagcggccggggacaggctccgaggcaggcccgacccgcctccccggcgccgccgtggctcgacggagaccagctagggtgagtgatcgagccacgcctggggtcccggcctgtcaccccgaagtccccgccgccttccaccctgtcaggctccaactctgggctccggcgcggtcccacctccggggggaactcccctccatcccctccatttccttcatcctcgactcccgctatcttttcggacctgcggcgctccccctggacgcgtcctcccgccggacgaccgtcctccgcctcaggggacgcgcccaggacgcacggcgccccctccccagccggaccggcggtctgggagcgcggatcccttcagctccc

SEQ ID NO: 326138 - DNA, 6276 bp, Homo sapiens
ctcgtagctccactctgcagcctcaaactcctgggctccagtgatcctctcacctcagcctcccaagtagctaagaccacaggcacatgctgccacccctgactaatttttcttttttaaaatttttttctcactgcgttgcccaggctggtctcaaactctttggctcaagccatccatcctcctacctcagcctcccaaagtgctgagattacaagcgtgaaccaccatgccaggagggaatgttctttcttgaacgtggctgccctgtcacctcagcattctttgcggcagctgtggcctaagcgtagccccttgctaacctcagctctttccttcccacctttcctggcctgcagctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcccaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacgctgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtaaaaaaaaaaaaaaaaaaaaaaaaaaaaaaaaggggggggggtaaaaatgttcttcccccagagggggggcccaacgtccagtagccgcagtaccccaggcctttctttggtcaacgaaggggggccccatatagggagaggctcggtataatataacgctaacagcgaccagtcggcccgtcttatacaaaaacgcgtcgtgtagatctgcggagaaaacactggcatacctaggagaactctttgtgggaagaggaacacctttaattatgtgtggcgggggggacaccaactaattggggcacaaactatctaccctctcaacaaaagattttgaaaacgcgccaatagggggaaaatgttttaaaaattttaaaaagggggaatacagttggtgtttaacaacaaaggcgagagtattgtagttgaggagtattggagaaagattagcggggataaaggagagagttgtatgtatggagacaattttttttttcccgggggcatatggtaaataaagagga

SEQ ID NO: 326139 - DNA, 6212 bp, Homo sapiens
ctcggagaccccgcgccgacggctgctcaaacatcaggctggcccccaagaggaccctttccaagtccccagctgggggccctgtgtagacctggagtggacacgcccctccttcccttcatgattcgtttgtagcgcagtggcgatggatgatgaggatgggagatgcttactagacgtgatttgtgacccacaggccctcaatgacttcttgcatggatccgagaagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcccaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacgctgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtaaaaaaaaaaaaaaaaaaaaaaaaaaaaaaaaggggggggggtaaaaatgttcttcccccagagggggggcccaacgtccagtagccgcagtaccccaggcctttctttggtcaacgaaggggggccccatatagggagaggctcggtataatataacgctaacagcgaccagtcggcccgtcttatacaaaaacgcgtcgtgtagatctgcggagaaaacactggcatacctaggagaactctttgtgggaagaggaacacctttaattatgtgtggcgggggggacaccaactaattggggcacaaactatctaccctctcaacaaaagattttgaaaacgcgccaatagggggaaaatgttttaaaaattttaaaaagggggaatacagttggtgtttaacaacaaaggcgagagtattgtagttgaggagtattggagaaagattagcggggataaaggagagagttgtatgtatggagacaattttttttttcccgggggcatatggtaaataaagagga

SEQ ID NO: 326140 - DNA, 6592 bp, Homo sapiens
caacaaaatcacaatctgtctcgattactcatttattcaacccgcattcacctactgtgtgcacgagcttttctagggcactggggaggcagaagggactaaaacaaagtataaatctccctgggctgcaagcctcgggagggcaggtccgggggctctgtgtccccactgggcccccagcactgcgcagcgcacacagtgggcgctcaccaagcgctcgctaagggcaacgcgtgaatccgtgtcccgccagcagggcgtttacggcctggtggggcggaaacggacccgacaccaccgcggcgtcctggggcttctgggaatcccatcagcgcggccagagcggccggggacaggctccgaggcaggcccgacccgcctccccggcgccgccgtggctcgacggagaccagctaggctggcccccaagaggaccctttccaagtccccagctgggggccctgtgtagacctggagtggacacgcccctccttcccttcatgattcgtttgtagcgcagtggcgatggatgatgaggatgggagatgcttactagacgtgatttgtgacccacaggccctcaatgacttcttgcatggatccgagaagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcccaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacgctgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtaaaaaaaaaaaaaaaaaaaaaaaaaaaaaaaaggggggggggtaaaaatgttcttcccccagagggggggcccaacgtccagtagccgcagtaccccaggcctttctttggtcaacgaaggggggccccatatagggagaggctcggtataatataacgctaacagcgaccagtcggcccgtcttatacaaaaacgcgtcgtgtagatctgcggagaaaacactggcatacctaggagaactctttgtgggaagaggaacacctttaattatgtgtggcgggggggacaccaactaattggggcacaaactatctaccctctcaacaaaagattttgaaaacgcgccaatagggggaaaatgttttaaaaattttaaaaagggggaatacagttggtgtttaacaacaaaggcgagagtattgtagttgaggagtattggagaaagattagcggggataaaggagagagttgtatgtatggagacaattttttttttcccgggggcatatggtaaataaagagga

SEQ ID NO: 326141 - DNA, 247 bp, Homo sapiens
actcctgcctcagcctcccaaagtgctgaatttacaggcgtgagccaccgcgccagccattttgtgtgattctaaattttttaaacttcccttgaatgttgccttttcagcctcccgtctctcttccatccccctcctttgtccatccctctcccacctacatcccatagctctgtccgtctctgaccacgtctttttccttttcgctgactttctcactcactgtctgtctctcattttctccaca

SEQ ID NO: 326142 - DNA, 400 bp, Homo sapiens
ctggcccccaagaggaccctttccaagtccccagctgggggccctgtgtagacctggagtggacacgcccctccttcccttcatgattcgtttgtagcgcaggtaaccagcgaagcatccctgttcattcctggaggggcaaccgtccctcattccacctccccagcaccaccttggcccctggatgaggaaggagcattccttcctggaagagcctggctaagcaatatctctggttctttcttctcccacctgggcctcctgggtcatctgggccatcaccctgcctctgcattagctgcaagcaaaatctttctctctgcccctttccccttttctccagattctttgcagaccatgcctttgcatgccttctgtgagcgggttggggagggaaggg

SEQ ID NO: 326143 - DNA, 6215 bp, Homo sapiens
gccgcatcagaggtcacacgtggctgtgaacccaggcctgtccctgtgtggccatccgtattctcggcagcccccgtgccgtggccatcaaccccgagccatggtacacagcatcatgctggtgtctctttgccttgacttggctggatgggctggtgggggctggcggctgggacgctgccctgcctgccctgctgacttttgaccttggatggggcgggtcttgttgcagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcccaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacgctgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtaaaaaaaaaaaaaaaaaaaaaaaaaaaaaaaaggggggggggtaaaaatgttcttcccccagagggggggcccaacgtccagtagccgcagtaccccaggcctttctttggtcaacgaaggggggccccatatagggagaggctcggtataatataacgctaacagcgaccagtcggcccgtcttatacaaaaacgcgtcgtgtagatctgcggagaaaacactggcatacctaggagaactctttgtgggaagaggaacacctttaattatgtgtggcgggggggacaccaactaattggggcacaaactatctaccctctcaacaaaagattttgaaaacgcgccaatagggggaaaatgttttaaaaattttaaaaagggggaatacagttggtgtttaacaacaaaggcgagagtattgtagttgaggagtattggagaaagattagcggggataaaggagagagttgtatgtatggagacaattttttttttcccgggggcatatggtaaataaagagga

SEQ ID NO: 326144 - DNA, 616 bp, Homo sapiens
tcggatcttcgttgtgtgagtgggtaagagatgaactggggggaggggtgtgtgtttgggcagtgagcaagccggcaagagaatgtgagtgggcggccagttggttggcaagtgagaggctgtggagaggttgctgctgggacgggctgtgcaattaaacagttgagcagatcttaatagcagactggggcggtgctctccgcaggcctgcggggagcagggagcaggggaagcaagcgagctggaagcatctttgggcacagagctagatacgaatttcagaagcacataacctgaggaatagaatgcaaccagaggagggagaaatagagattccaggcagcgtttcctaaacttaaaaagttttgaatacccagttttgccttgttctggggacctctggcaatgttgttcaagggaggaatttttaatttcatagaaaagtgaattttaccaccacaagagaacatgagaccaaggtcataaatccctttgtttggagtgtccgttctgaactccttgtatacttttatttgcaggaagaggctataccagcaagtattatggttttactgggtggggcggcaaggccaggaagagatggagatgctgttaa

SEQ ID NO: 326145 - DNA, 446 bp, Homo sapiens
ctcccctcaatgggaagtagaatctctttctccacctcttcaatatggctggccctggaacttcccttggcacacagaatgcagcagaattggcttcatgttgtttctaagccttggcctcagaggccttgcatgcttcctaaccctggctctaggaaacttgctgctgtcatgtaagcaagcccaggctaacctactgaatgttggtgtgtcccagtcaaatccagcactgcaaccaatagccaggcagccaccagacatgtgagtggggccacctcacaccagccaacctccaccaagtcatcagatgtatgagtgagaacagcccagaacaactgagcccgtccagaccagcggaacaaccaagctgaccagtagacttaggagcagtaaacagatgattgttatggaagccattctgtttagggtgtgtgtgttattgcttg

SEQ ID NO: 326146 - DNA, 347 bp, Homo sapiens
tttttttgagacagagtctctgtcgcccaggctggagtgcagtggcacgatctcggctcactgcaaactccacgtcccaggttcaagccattctcctgcctcagcctcccgtgtagctgggactacaggcgccagccatcatgcctggctaattttttttgtatttttagtagagacggggtttcatcgtgttagccaggatgttctcaatctcctgacctcatgatctgcccacctcagcctcccaaagtgctgggattacaggtgtgagccatcgcgcctggccgacaaaagttgtcttactcatcaatgcagcctcgacacttagcatgagatcttgcacatgg

SEQ ID NO: 326147 - DNA, 370 bp, Homo sapiens
agctttcaaaacacactgttaaaatggtcctcaaagtgaagacataatcaggcttagcaattctctttggtgattttatttgatctgtaaccaagcagcttcagctgtagctttaaataaactgaggggtggagccgggtgagaatcggggatttggtgaagatgtttcgttcccagggcacttccacaaactcacagggaggccgcaggatttttttaattttcaaagaaaatacagtggcactgaacatctgtcctattaatgcttaactattagctaagattgttaagtttcaaattaggctgtgctgcattctctttgatgaaatatctgggaagctgagcttgcggaggtttgggtgataagaag

SEQ ID NO: 326148 - DNA, 406 bp, Homo sapiens
catgccttgttccaaaccttttgtggtagtttaaaaggatacacaataaaaattacaatatgcacacagagacacacatacatacaaactattttgcaatctgcttcttccacttacctttatgttactattatctttccgagtgggtaactttgcaaaaagatttgaatatgaaagtggctttgtaaatgtgaagttgtgatgctagtattcccattaggatactgaaatcttagaagacatgcacctatactcaggccgtgatttgggtgggaatcacagcacatgtgtaacgagtgctcaggacactcacagtgcaggtgcaaaggcaagatgcacagtcaagccttcctccagttgaggtctgagaatcacctgctttcattagggatactttttcttcttt

SEQ ID NO: 326149 - DNA, 1258 bp, Homo sapiens
aggacaagtactatataacagttggcacaacccaccccacaacagaagagaacacatttttctcaagcatatgtggaatagtttccaggagaaaccatgtgttaggccacaaaacaaatcttaatgaaatgtaaaagactgaaacacaaagtaccatttcaagtcacatagaatgaaacaagaaatgaaaaacaaggaaaactggaaaattcacaaatacattttattgtaagcaacacactcctgatctatcaatgggtgaagcaagaattcacaaggtaaattagaaaacatcttgagacaaatgaaaacaaagacatggcataccaaaatttatgagatgttgctgtagtctaaattttgtctcctaggctgggcacggtggctcacacctgtaatcccagcactttgggaggccaaggtgggtggatcacaaggtcaggagattgagaccatcctggctaaggtggtgaaaccctgtctctacttaaaaaaaaaaaaaaaatcagcccagtgtggtgctgggtgcctgtagtcccagttatccaggaggctgaggcaggagaatggtgtgaacctgggaggcagagcttgcagtgagccaagatcacaccactgcattccagcctgggtgacagagtgagactccatgtcaaaaataaataaataaataaataaataaataaataaataaataaataaataaattttgtctcctcaacttgcgtatgttgacatcttaactcccaaagtgattgtattaggagctgggaattttgggacatgatgaagtcatgagggctctgcagaatgggattacccccctcatggaagacaccccaaagatatttcatgccacttctactgtatttggttacttcaagaagatggctctctgtgaaccaggaaaagggccctcatctgacactgaatctgactgtaccttgagctttgacctaatctccagaactcggagaaataaatttatgttgtttattaaccaccagtctatggtattttgttatagcagcctgaatggacagatacagtgaaagtagtgaaaagaaggcaactcatagcagtaactactcaaattcaaaaagaagaaagatctcaaagactaagccaaggaatgtttcacagaattcagcctaaaaagaaaagtgctggaaaggatgtaaattaaataatgtatgagataagcaaaaagcttcaatatccagctacaaggcattctagaatgagagaatagaaaaaa

SEQ ID NO: 326150 - DNA, 781 bp, Homo sapiens
ccactgcattccagcctaggcaacagagcaagatcctgtcaaaaaaaaaaaaaaaggagaaaattctcttggcagtgggtaagagtagttattagggttgtagatttcctgtctggaattagagaaagaagggtcatattttctgttattttgtgtatctacctctaagtggactgtttgcctcttgtcacgaattagtagcctcttcagtttaccatcatgtgctcttattttctctgcatacagtgaagtgattgtcattacaatttataatcctgacctggtacttttatatttaattgggctgatattttctaattcttcccagtgtacaaaggttttatgctttgttgttgttgttgagacaggctaggtgctttggatgtggagaattaaatgagcatggcattttcagaggatacttgttggagattgcttgggtaggatggatgtagtcaggtaatggggcctagaaattcagactgaagcatttggtattgatgtgatgggaactggcagcccttgagagattttagctgagaagtgatgtaaaatctgtttggaagactttgagtagaggagattagaggcaaggttaggatgtagggtatgttgcaatagtaattaagacttaagaatcggcccagtggcatgtacctgtagtcctagctactctggaggccgaggcaggaggatcacttgaggctgcaattagctgtgattgtgcctgtgaatagccactgcactccaacctaggcaatataatgagattctgtctctt

SEQ ID NO: 326151 - DNA, 572 bp, Homo sapiens
ccactgcattccagcctaggcaacagagcaagatcctgtcaaaaaaaaaaaaaaaggagaaaattctcttggcagtgggtaagagtagttattagggttgtagatttcctgtctggaattagagaaagaagggtcatattttctgttattttgtgtatctacctctaagtggactgtttgcctcttgtcacgaattagtagcctcttcagtttaccatcatgtgctcttattttctctgcatacagtgaagtgattgtcattacaatttataatcctgacctggtacttttatatttaattgggctgatattttctaattcttcccagtgtacaaaggttttatgctttgttgttgttgttgagacaggctaggtgctttggatgtggagaattaaatgagcatggcattttcagaggatacttgttggagattgcttgggtaggatggatgtagtcaggtaatggggcctagaggacaaagagaagaggagacagctacagtaagagatggtcactacacttctccgaagacaggaagtaagtggcaccgctctactttgcagagctgcca

SEQ ID NO: 326152 - DNA, 523 bp, Homo sapiens
tagtagagggatgatgctaataattaggctgtgggtggttgtggttgattcaaattatgtgtttttttggaaagtcatgtcagtggtagtaatataattgttgggccgattaattttagcattggagtaggtttaggttatgtacgtagtctaggccatatgtgttggagattgagactagtagggctaggctatgtgttttgtcagggggttgagaattcagactgaagcatttggtattgatgtgatgggaactggcagcccttgagagattttagctgagaagtgatgtaaaatctgtttggaagactttgagtagaggagattagaggcaaggttaggatgtagggtatgttgcaatagtaattaagacttaagaatcggcccagtggcatgtacctgtagtcctagctactctggaggccgaggcaggaggatcacttgaggctgcaattagctgtgattgtgcctgtgaatagccactgcactccaacctaggcaatataatgagattctgtctctt

SEQ ID NO: 326153 - DNA, 458 bp, Homo sapiens
tgtctagaacaatgattgtaaacaaaatccctttccaaggataaccctcctgaaacttatgaatattatgaagagaagatgctaaaagttaccaaaaaataaataaaagagatcacatacaatgaatctaggataagaatggaaaaaatggcaaaagcattctcaacaacataagacagtggagtggctgggcacgtggatcatggctgtaagcccagcactctgggaggatgaggcgagtggattgcttattaagtgcaggagttcacgaccagcctgggtaacatagtaaaaccccgtccctaataaaaatataaaaaattagccaggcatggtggtgggcgcctgtatgggaggccgaggtgggaaataacctgagcctgggaggtcaaggcttcagtgagccaagaatgtgccactgcactctagcctggacaatcagagtgagactctgactc

SEQ ID NO: 326154 - DNA, 1684 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgc

SEQ ID NO: 326155 - DNA, 509 bp, Homo sapiens
aatttaattcacctacaattgataatgaacaaattcagtatgttatataaaaaacaagtagaaagaaaatggtgatgatcgtatagttttttataatgttctttaaagctcagtttcatgtgttaatccttattttatgtggaatttattattattataccctttcagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgc

SEQ ID NO: 326156 - DNA, 418 bp, Homo sapiens
atagagatggattaacagtaggaagagtttaatattacaagaacaaaggaagcaaaacagcaatttggaaagtttagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgc

SEQ ID NO: 326157 - DNA, 600 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggtaagtcagcctaagtgtagtgtgtgtgtgtgtgtgtgtgtgtgtgtgctctcttttcaagagaaaaaggaagggacagtgttggaaccatatggacagtcactccggcacacacttctgacgaacttaccttgtgtgaaacggcgtacctaaatggtttttggtggtggggaggtggcactgagtgattcagtacccgggaatttaaggacccgggttaattcttcaggaggagaattaaaagaaaccggtagcactttgagtgtagcctatgttttaaatttttcgttgcagaaacggttacctaacattatattgtttttaaaacttgtatggttccagatcataattctgtagttttaaagctcaatccgtagattgtttcgtgtttactcttatgaaagaatttgttaaattattcattgtaaataatgcattcccagtgtcgtctctctgcagttc

SEQ ID NO: 326158 - DNA, 3249 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagag

SEQ ID NO: 326159 - DNA, 3777 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaatggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaacttcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaaaaaaaaaaa

SEQ ID NO: 326160 - DNA, 3185 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagag

SEQ ID NO: 326161 - DNA, 3417 bp, Homo sapiens
ttctttctttctttctttctttctttctttctttctttctttctttcctttctttctttctcttcttttccctccctccttcccttcctttcttcctttgtttctttccttctctcctctcctcttttctcctctcctcttcctctacttcctctcctttccttttccttttccttttctctctccttccttccttcctttcttcctttcttccttcttttttttaatgagagacagggtctctctctgtcacccagcctggaatgcaataatgcagttgtagctcactgcagccttgaactcttggtcctaagtgatcctcctgcctcagcctcctgagtagctgggattacaggcacctgccaccacgcctgactaatttttgtatttttagtagaaacggggtttcaccatgttggccacgttggtctccaactcctgacctcaagtgatctgcccacctcagcctcccaaagtgctgggattacaggcatgagccaccgcgcctggagataagtttatttttcataggagtatcatttaggttccttgcaaagaccaggggttttgaggtaaagcagaatttggtaagagcaattttgtgccagatcaaccagaaaatgaaaaaatattgaccttttaagctttatttctattagtttttgtatgtacttctaaaatatgtatcactgataccagtgacaaacctatctaaatattgataatatttcttttccttttaggattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaacttcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaaaaaaaaaaa

SEQ ID NO: 326162 - DNA, 2655 bp, Homo sapiens
aatttaattcacctacaattgataatgaacaaattcagtatgttatataaaaaacaagtagaaagaaaatggtgatgatcgtatagttttttataatgttctttaaagctcagtttcatgtgttaatccttattttatgtggaatttattattattataccctttcagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaacttcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaaaaaaaaaaa

SEQ ID NO: 326163 - DNA, 2006 bp, Homo sapiens
  misc_feature (6)..(6): n is a, c, g, or t
aaatcnggcttttaataggttccactggaagtaggagaattttccaagaacccatacttcgacatttcctctgcccacaaaaaatgaacgcattttaagtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaacttcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaaaaaaaaaaa

SEQ ID NO: 326164 - DNA, 283 bp, Homo sapiens
attttttagtttattttttgatagtttatattcttttagttaccaataatgccttttttggttatttctgtccttaattagtgaagaatattttgtcgaacttatgatatccatgatccaaaggtaagaaatttactctttaaagatttttctgtgtcacaaagtattttcaatcaaaattcagcttttatttagttttaataatttccattgccatcacttcctattgatgcctacaaacaactgtagtttttattttgaaatatgattaattttattacag

SEQ ID NO: 326165 - DNA, 3830 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaacttcagtaaagagactacaaaaggatgatcttcaagaagggaaatgattctaaaaggattatctgaaattgaaaaactagtaagcaaataaatgataaacataagtaaatttaaactgttgtttgtataaaacaattataatgaagtgtttataagaaattgtaaacaaatgtaaaactaaataaacattgttatgcaacattaaaaaaaaaaa

SEQ ID NO: 326166 - DNA, 3211 bp, Homo sapiens
tgatgaattcagtggcagtgaattgagaccggagggaatctggcccctagaggctggtacttgggcccgaaacccccatctccggcggagagaccgtccgaggtaattgtctgccacgagtgcacattctgaaaacaggagattttagttcctaaaaatgggaagaacctacattgtagaagagactgttggccagtatctttcaaacataaatctccaaggaaaggcttttgtctctggccttttaataggacagaacgccacccaaagaggagcaaagtgagaacctcaaacatcccaaagctaagttggataacttggatgaagaatgggccacagaacatgcctgccaggtatccagaatgctaccagggggacttttagttcttggagtatttattattactactttagaactggcaaatgattttcaaaatgccctgcgtagactaatgtttgctgtggaaaagtctataaatagaaagagattgtggaatttcacagaggaggaagtctcagaacgagtgacacttcacatttgtgcttctacaaaaaaaatattttgtcgaacttatgatatccatgatccaaagagttcagcaagaccagcagattggaagtatcaaagtggattatcatcctcatggctttctttagagtgtacagttcacattaatattcacatcccactttctgctacttctgtcagctatactctggagaaaaatacaaagaatggacttacacgctgggccaaggaaatagaaaatggtgtttatttgattaatggacaagttaaagatgaagattgtgacctattagaaggacagaaaaaatcttctagaggaaatactcaagcaactagtcattcttttgatgtcagagtgctaacgcagttgctcctgaattcagaccacagatccacagccacagtccagatatgtagcggttctgtaaaccttaagggtgctgtgaaatgcagagcttatatccacagcagtaaacccaaagttaaagatgctgtgcaggcagtaaagagggatatattgaacacagttgctgatcgttgtgaaatgctatttgaggatctgcttttgaatgaaattccagaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagcttgtatgagttcttctatgaatagtcaagcttcattggacaacacagatgatgaacaaccaaaacaaccaattaaaactacaatgttattgaaaattcagcaaaacataggtgtgattgcagcatttacagttgcagtccttgctgcgggtatctcctttcattacttcagtgattagggtgaggcacaaagagtttcttgatcatccagagaacattgacagacaattatgaataataaagatgttaacaatccatctgtatttaaaacactagcagccagatctgctgccatgatgcctatttggtgtgtttctgattaaaatgaaatcacaagctgccttgtttagcctgctttacattgtaggtggcccgcatttccagaaataacgttatgcatctagatggaagctgcatgtaacaaatcattattatctatttttaaaagcttcaaaatgatgggatatgatcatagattttagtcttactaatctgaatcacatattaatcaggacattaaaaactttaacagaggcatgatggctcacacgtataatcctaatgctttgagaggctgaggtaggagcatcacctggggctgggagggagttggagaccagcctggatgacataatgagattctgtctctactggaaaaaaaaaaaattagctggacatggtggcaatcagctctagtcccaactacttggaggctgaagcaggaagatcacgtgagcccaggagtttgaggctgcagcgagctatgatcacatcactgtactccagcctgggtgacaaaatgagacattgtctctaaaatacataagtaaatttaaaaaaaaaagaataataatttgaacagtgaatgttgatgtaacatcttaataatagagcaccagaaaaatttctaccaaatgagacaacaactttaggataagttcatcctctaggagctttctaatgtgcactcagttcctgtatactgtgtgttttgttctgatcaaggggtagggaacctttccagagaagtcccattagtaagaaatgacataaaatacgtgctttctcaggttactgtataactgttataatatatttaatatataaaattaagacttttgcttccagcaagtatgttagactagatattataaaacaactagatcctgaataaaatctgcttttaataggttcactggaagtaggagaattttcaagaaccatacttcgacatttcctctgccacaaaaaatgaacgcattttaagttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagag

SEQ ID NO: 326167 - DNA, 605 bp, Homo sapiens
tctggacaatgctggatgtaaagaaaactgtgaagctacctctaagcatattgtttgtgaatactgtgtaccatttagaggataacatgggggattcacatgaagttatgtgaaaatattttataaggaataatacctaagtgcctctcttaagttctccagtagaatgtattttcaatttttgccacaagggggagaagttatttttatagtaatatgtacatttttttattttaaaaatagaattcacacaactttacagcatctatgaacattttgctatcccaattatgtgtgtgtgtgcatgtgtgtaaacaagattctgaaagtcttgcatgagaaaaatttcaaaggaaattaataacaaaaccaaaacagttttgaagaacatgtgcacagtggacacaggaattgaacaaagtttaccatgattaacattatgttttcttagttatatatcacattgaattcctttatcaactctaataagaatctactgattagtgttctacattctgctttttaaagaaaaatttttgaaacaatcagacttaacagaagggttgtaaatactgtacaaataaaatttttcccttttgagaata

SEQ ID NO: 326168 - DNA, 905 bp, Homo sapiens
ctccattttttaaggtttttaagtttgagtctctattaagaattagtgggaaagaacacaaaactaattgtcaaactaaggcatgaagattgtggttatagtccaagctaaggtagccagcccctcattaatggaaataaaaattaatagtcgtcagttttctctatcctcgtatattaaaactttgattttgttttcagttataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggtaagtgttttaaatgcagcatgcaatagttattttattgttaactgagtactaaatcatacgagctggtgaattaaaaaaaaaacaaaaacccaaaagtaagtatttcctttttgctgtcgaccaattcctaaataaaacacatcagaccatggaaaagatggagggattttaaaatgtttttctagcataattaatttatttttattataggtcatatttaggccctcgtcacatcttctttggattactttcttggtctggcttcccatccagctttcttattgctgctagagtgatgtttctgaaaacatatctggtcatgttcctatccctgcttaaaaacctttgttggctccctgttacctatgaaataatatttaagttcctcagaatgacaaatccaactgctttcttcagttttcagacctctcttcagtacattcagaacccccacctttccaca

SEQ ID NO: 326169 - DNA, 455 bp, Homo sapiens
agaagagaatttttcagaaatatatgtaatctttgctgtttggggggtaaaattaatgcttgtctccctgaggaatatggaaaataatcagattttaggggtttaaataatatttttaaattgtaaatgggatttttttattcacccaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326170 - DNA, 398 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataaaataaaaaaaaaacctcgggggtcttttggggcgcccggccccatcgttttccccccgggtgggtcccggtaagtttccccatttcccccttagtgggcgttt

SEQ ID NO: 326171 - DNA, 6889 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgggttttgctccatttaaagacatgaaatgaactacagccaggaaggtgatagatgatataataagccacctctgaacctacaccccgtctcttcacggtttagacttactaaaataaatacaaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326172 - DNA, 4381 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaagg

SEQ ID NO: 326173 - DNA, 5081 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326174 - DNA, 5208 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgggttttgctccatttaaagacatgaaatgaactacagccaggaaggtgatagatgatataataagccacctctgaacctacaccccgtctcttcacggtttagacttactaaaataaatacaaggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326175 - DNA, 4512 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggaaaaaaaaaaaatgaaaaaaaaaaaaaagggggggcggaataaaagtttcccttgggggggggccaaattttaggggttaccaagattttttggtacaaaaggggggcccatataggggagggcggaattt

SEQ ID NO: 326176 - DNA, 3956 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcatcctttgtggcagcacgtgctgccacaaaggatgccacctctcttcctgtcaccgacacttcctcagcatccacaggtcacgccacccctcttcctgtcaccgacacttcctcagcatccacaggtcacgccacctctcttcatgtcaccgacacttcctcagcatccacaggtcacgccacccctcttccttcccttaaa

SEQ ID NO: 326177 - DNA, 5927 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326178 - DNA, 5415 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcgagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326179 - DNA, 4162 bp, Homo sapiens
ggctgattcctagaggatcacgtgaaagcacaccccggctcctgaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326180 - DNA, 2932 bp, Homo sapiens
tgattgcatttagactatggtgagctcaggtgattgatactcctgatgtgattgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326181 - DNA, 2041 bp, Homo sapiens
tgatgtttatggcttcattttatgtaattttttaagtaagttccactagaaacagttcatcttataccttcaaaactgttacctgttctttaaaaaacaaagttgcttgttacttgttctttgtgttttaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326182 - DNA, 2263 bp, Homo sapiens
agaagagaatttttcagaaatatatgtaatctttgctgtttggggggtaaaattaatgcttgtctccctgaggaatatggaaaataatcagattttaggggtttaaataatatttttaaattgtaaatgggatttttttattcacccaggcacctaattacaacaagcatgcacattttggtgcattcaagaatggaaaatcagaatagcagcattgattcttctggtgggttttgctccatttaaagacatgaaatgaactacagccaggaaggtgatagatgatataataagccacctctgaacctacaccccgtctcttcacggtttagacttactaaaataaatacaaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326183 - DNA, 2233 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctgtagctgttggtcacgtgaagatgacagccgatgagcttgtgtataacattcacctggatgtcaacttcttggtgtcattgctcaagaaaa

SEQ ID NO: 326184 - DNA, 1731 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgtcccggtctctgtacgtttggatgataacgttcaataccatgatgtagaggaagcagatgaacgtagcgatggatagcacacgagcacaatccagaggcaaggccatggtgtatagacga

SEQ ID NO: 326185 - DNA, 1124 bp, Homo sapiens
  misc_feature (1076)..(1076): n is a, c, g, or t
  misc_feature (1093)..(1093): n is a, c, g, or t
  misc_feature (1114)..(1114): n is a, c, g, or t
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaattcctctaagatctctctggaagaaatngcaccacaaaactgtcnagctaagaaaattgctcaacnctgtatcaga

SEQ ID NO: 326186 - DNA, 235 bp, Homo sapiens
gtaagttcacattttatattaactttagagttcattgtaacaccatgcaaaagcatgctgcttgatgcaatcacagattattggagaactctgaaaaatcacatcacagtgccatctttaaaaattgtggcacatccaacagctgcatgaactcgtgtgtattctaaaagcagcccagaaacatcacaaatggagtgaggtaaagtcttgatgtacaacctaaatatattcaaaa

SEQ ID NO: 326187 - DNA, 439 bp, Homo sapiens
gaagccttttaattaaggcgtcacaggtgcagctattctaccttaatgaaatgggtagtgattttcccaccattatttatttcggtgataatatgctgcatattcaagtctcttgtagttattttcacccaaagtagttgacaatttgatgcttctggtgatgtttatggcttcattttatgtaattttttaagtaagttccactagaaacagttcatcttataccttcaaaactgttacctgttctttaaaaaacaaagttgcttgttacttgttctttgtgttttaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggta

SEQ ID NO: 326188 - DNA, 311 bp, Homo sapiens
cttttcatagttaggaaattgaattaaaaataaatagaaaaggaatttttaaatgaatgtctttgttctcagtattggaattaataaaacttttcaaagccaataatttttatttatttgtattaattattcctggcttgaattaaattcccttgaaaaaatgttttgcaggttaatgaatccaaaactattttaaagctttgcgattttgggtcggcttcacatgttgcggataatgacataacaccttatcttgtcagtagattttatcgtgctcctgaaatcagtaagtttcttaatgttctttgacc

SEQ ID NO: 326189 - DNA, 6685 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326190 - DNA, 6762 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326191 - DNA, 6919 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcaaaaaaaaaaaaaaaaaaatttgggggctggcccggaaagttttaaaacctcctgtgggggcgggcccggttaggacccggccacgtgccaggacacggcgacatgggggtccccaaaaaccgggccgggtctggaaccgggtgggccggtcacggcg

SEQ ID NO: 326192 - DNA, 6255 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326193 - DNA, 6720 bp, Homo sapiens
ggacgcgtgggtcgacccacgcgtcggatggccgcgcggggacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctaaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326194 - DNA, 4062 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcgagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326195 - DNA, 3874 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaagg

SEQ ID NO: 326196 - DNA, 3692 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggcataaaccttccactcttgaacaaagcagctgctttttaaaagcgagaaaaaggaaaacggggcacaggccattcgacgccttctccaaggggtctgatttgctgagacaccagcttcaccttcttaacaaggcacctaattacaacaagcatgcacattttggtgcattcaagaatggaaaatcagaatagcagcattgattcttctggtgcagctcagtggaagatgatgacaaccagaagacatgagctaagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatca

SEQ ID NO: 326197 - DNA, 3354 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggttcatctcagaagaagttgttggcacctgatatgtttacagaatctgatgatatgtttgctgcgtattttgatagtgctcgtcttcgggccgctggcattggaaaagatttcaaagagaatcccaacctcagagataactggaccgatgcagaaggctattatcgtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgcaaaagactggtttaaaagaattagagttcttgaaaaaacttaatgatgctgatcctgatgacaaatttcattgtctgagactcttcaggcacttctatcacaagcagcatctttgtctggtattcgagcctctcagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggttaatgaatccaaaactattttaaagctttgcgattttgggtcggcttcacatgttgcggataatgacataacaccttatcttgtcagtagattttatcgtgctcctgaaatcattataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataagatgattcgaaaaggtgtgttcaaagatcagcattttgatcaaaatctcaacttcatgtacatagaagttgataaagtaacagagagggtaagtgttttaaatgcagcatgcaatagttattttattgttaactgagtactaaatcatacgagctggtgaattaaaaaaaaaacaaaaacccaaaagtaagtatttcctttttgctgtcgaccaattcctaaataaaacacatcagaccatggaaaagatggagggattttaaaatgtttttctagcataattaatttatttttattataggtcatatttaggccctcgtcacatcttctttggattactttcttggtctggcttcccatccagctttcttattgctgctagagtgatgtttctgaaaacatatctggtcatgttcctatccctgcttaaaaacctttgttggctccctgttacctatgaaataatatttaagttcctcagaatgacaaatccaactgctttcttcagttttcagacctctcttcagtacattcagaacccccacctttccaca

SEQ ID NO: 326198 - DNA, 2134 bp, Homo sapiens
tccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaatggagaagtatcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagaggttattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtctccacttttgaatgatagaagatctaagcagagcaaatccccctcgcggacactgtctcctgggagaagagccaagagccgatccttagaaagaaaacgacgagaaccagagaggagacgactttcttctccaagaacacgacctcgagatgatatcctcagtagacgtgaaagatcaaaagatgccagccccatcaatagatggtctccaacccgaagaagaagtagatctcccattagaaggaggtctcgttccccactcagacgtagcaggtctccaagaagaagaagcagatctcctcggagaagggacagaggtcggaggagcagatcacgcttgcgaaggcggtctcgatcacgcggtggtcgtagacgaaggagcagaagcaaagtaaaggaagataaatttaaaggaagtctttctgaaggaatgaaagttgagcaggaatcttcgtctgatgataaccttgaagactttgatgtagaggaagaagatgaagaagccctaatagaacagagaagaatccaaaggcaggcaattgttcagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggtgagagagttttgtcctggcgacgcttttctctgaattgttagctctgtaactttataataagagacgttatttggggtgggattaggaaaagtaaaagattagacatgttgcttctgctgaatattgcagtaatataatattaaatatgtccttagaaatgttctctataaatgtgtttttattagttcacatatcctgaata

SEQ ID NO: 326199 - DNA, 937 bp, Homo sapiens
aaccaaacctcttgctctgctatatctccactctgcctcagactgaaaagctagtcctaacgtctttgccttaattctgttcattttttcaagtccttgaaggaccattcttccctgattctcaggctagaagtgtcacttttcttatctgtacttccaaagcactttcgtatatttttattatggcatttatatatagttcatttatatttaaattttaattccatgaacaatcaagtaccaagtataatggagaaggtgctcatcctctgccttccttgagcttctgggtgatgccaggcccaagtctttgtggcacccagctccatgctttgaatactatgtggctgaatgaatttttaaaatctcaaagcagttaaacagcaggaaagcccattaacttcgtactgaaaaagcaacatactgtgatgatacgggatgacatcatttcaggttgggcatacaaaaaagtaaggaagctaaactaagactatactcaccaggccatttagaagttttaaataatgcctccactattttttttcttagacatagcttttaatggggaaatggaattttgttattaatacccattatattcctgtaagtaaatgactatttttcccttaactcagtgattagacaggaaggaagacattagtgattagacaggagggaagatattagtgattagacagcagggaagatattagtggtaaagagtgaatgatagtagtgaatataaatggggctgaggaaactttaagcataaaagattcctgagatgactttacaagtctgtacgaatctgccttgactgtatatttcatactgcccaacaaaacaataaaaaacaattttaaatgcatatttttaaatgtacacagttttctatttcatcagacttaagtaaaaagcttccacatgaagacccttt

SEQ ID NO: 326200 - DNA, 908 bp, Homo sapiens
aaccaaacctcttgctctgctatatctccactctgcctcagactgaaaagctagtcctaacgtctttgccttaattctgttcattttttcaagtccttgaaggaccattcttccctgattctcaggctagaagtgtcacttttcttatctgtacttccaaagcactttcgtatatttttattatggcatttatatatagttcatttatatttaaattttaattccatgaacaatcaagtaccaagtataatggagaaggtgctcatcctctgccttccttgagcttctgggtgatgccaggcccaagtctttgtggcacccagctccatgctttgaatactatgtggctgaatgaatttttaaaatctcaaagcagttaaacagcaggaaagcccattaacttcgtactgaaaaagcaacatactgtgatgatacgggatgacatcatttcaggttgggcatacaaaaaagtaaggaagctaaactaagactatactcaccaggccatttagaagttttaaataatgcctccactattttttttcttagacatagcttttaatggggaaatggaatttttaaatgactatttttcccttaactcagtgattagacaggaaggaagacattagtgattagacaggagggaagatattagtgattagacagcagggaagatattagtggtaaagagtgaatgatagtagtgaatataaatggggctgaggaaactttaagcataaaagattcctgagatgactttacaagtctgtacgaatctgccttgactgtatatttcatactgcccaacaaaacaataaaaaacaattttaaatgcatatttttaaatgtacacagttttctatttcatcagacttaagtaaaaagcttccacatgaagacccttt

SEQ ID NO: 326201 - DNA, 412 bp, Homo sapiens
tctttgttgtggcccggtgtgcgtgcgttgtgtggcactgtggtggcggcggtggcggcagctacgtgtttcgtggtcgggactcggacaccggcgcgtctctcaagctcgcctcttcggtagctggaacgcctgattgtccccaacgagccggctcgattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326202 - DNA, 1786 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326203 - DNA, 2245 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcataaaaaaaaaaaaaaaaaaaaaaaaaaaaaaaaaaaaagaaaaacagagacaggacagaaacacaagataaaaaacgaacgagggggagggcgcgcgcgatcaaaaacagatactacccccgcgggagggggagccacgctaagatcgagcagcagcccaagtcagtagtggaagacagatgggtctgccataattaagtagagtactaatataatattaagacacgcacgcgggccgccaactttattaaaagaccgaagatttagatagaaagaagcagctcatcctgtgtaattttattggtgaaacacactcttgttgttgtggtgagcaaataagtgaacacactatccgtgttgatttagaacagcggagcgtatatacaatcttgtggagttttatgaggagaacaaacacaatggcgagcaggaaagaatgaccgcgtgttttagaacttgc

SEQ ID NO: 326204 - DNA, 1769 bp, Homo sapiens
agcggattccggccgtccgcgagctggcgtcggctccgcgcggggtggctggcccgtcacccctgtggtcgctcactgagctgtcctcgtctctctctgcttccctgcgtgcgcgcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326205 - DNA, 1959 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326206 - DNA, 2037 bp, Homo sapiens
tccccaggccctgtctggtggtggccgcccttggggagctggcctctcagcacagcgccgggcaccggggctcaaggtcagtgggtgtgtgtttgggcttgaactgatgtgtgtgtttactgagctttctccgcagcctgctccggcagctccaaaatggcatttcaggaattgaattaccgacatttcagtacttgcggaatccaggaatagattatttgattgtatctgttggaagtcattgccgtaactggcttcgttttcttcaccaacatctaaaccgagtggggagggacagcaggagaatgctgtggtgacttgattttcccaaaagcacatctcccaagctggcggcagccgatggcgttgccctgtgactgggggaagcctgaggactcacggtcgcctcaggctggccaccttcgcactggaacctgcccatcacatcaaggagccctctcaggctgaaaaccctgtgccggggtggctgcagcaacacaaggattcccctccagctctgtgatgtggggagcagagggccactgagtcctgccatgggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326207 - DNA, 2056 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctgctggagaactcctggaacctttaagccctggctcagccctcagctctgtcccatcccagctgacctctgtgctctgcgcccgagctcctgagcccacggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326208 - DNA, 1266 bp, Homo sapiens
tggtgatctagaggatcccatctcaggcaggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326209 - DNA, 780 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagccagttggcttcggttgtcgcctggcgtgaggtactcagcggggggatgtggtcggcggctctag

SEQ ID NO: 326210 - DNA, 537 bp, Homo sapiens
ctctagaggtgttactaacctcctctttccccggatctgactcagcagggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtaattatgaaatacaaacgccatgatctttcactcaagggcactaaggagtgaataaataaaggataccacagggtgctaatgagcttgaagagtccctgtttggtagccccagatccagggtccctggtatcacccactgaatgctacttctacccagcactgcccacgggaaataaagtgggagacacatacctatgtgattgtaactttttctatagccgcattgaaaagtaaaaaagatgaaatttaaaacttgtttgatttaaaccgttagatcccaaatggtatcatttaccatttcacatgtaatcaa

SEQ ID NO: 326211 - DNA, 1903 bp, Homo sapiens
  misc_feature (1)..(6): n is a, c, g, or t
  misc_feature (107)..(107): n is a, c, g, or t
nnnnnnagcttctgccaagggtgggggcccacgcggaggcgatccgctcgttcctcccagggccatggggcgacgaggagagccctggcctccccgcgacccgcacngcgacctgggccagacgcgccaccttccccggtcgcggtttgcttctctttaaaatgaggacagctcctcccttgggggctgtggtgacaggtgaaatgagaacgcactgaagacagctcttggtccaaagccccgcacacagggcatggtctagtggcccagtcaggacgcggaaacactccctggaggttctgacccgctccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326212 - DNA, 1838 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcataaaaacgaacagtagaccccaccactatcccatcccgagaacagacaacgcg

SEQ ID NO: 326213 - DNA, 1759 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctccccacctcccccccccctccctgtaaactaggtgagtgcagcaagcagaccttcgcatcaccccagcagtcaccaaaaaccagtgagagcgccgctgtctcccgcccggcaccagcactcgctagctttcctgacccctggaactgggctctgggctcccatcggaaaataaactccaagcagccagta

SEQ ID NO: 326214 - DNA, 1557 bp, Homo sapiens
tccccaggccctgtctggtggtggccgcccttggggagctggcctctcagcacagcgccgggcaccggggctcaaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326215 - DNA, 1836 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcagatgacagcacctggagtgttagctggtcatacctggacctgcgagtgtaggggcatggtctagtggcccagtcaggacgcggaaacactccctggaggttctgacccgctccctctcagcctccgcctggtctctggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326216 - DNA, 2009 bp, Homo sapiens
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcagatgacagcacctggagtgttagctggtcatacctggacctgcgagtgtaggggcatggtctagtggcccagtcaggacgcggaaacactccctggaggttctgacccgctccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcaggccatctacaagatggtgtcgtctgtgatgaagatgccggaggatgagtccaccccggagaagcgcacagacaagatcttcaggcagatggacaccaacaatgacggcaaactgtccttggaagaattcatcagaggtgccaagagcgacccctccatcgtccgcctgctgcagtgcgaccccagcagtgccagtcagttctgagcgagcggcccctggacagttgcagagaaacacaggcttgtcgtgccgtttaagctttgcttgcaagagtggatgccccgcaatcgttcctgctctcccgggccccgggcctggggcatgcgttgcacctgcccggcccggtggctgcgcctccctcctccacctgaccaacgcgacattcctcccctcacgcctggcccggtcccttccagggcaactcccagggatgtggtgacatgcagggttcaagtgttcttggttccaggcacctcccggctcacggggagctcagaggtccatgccgaggagaccaggcaggacctcccgaggctgcgccccggccggcccatgcgttttgtgatcccaagtgactctgtgggaagggtggggacgaggcgtcgggagggtatacagggagcccctcccgtgcatggctgcccccccgttcattttctccaccacagccgcttgcacgtatagatactgtggtcccctttcttttaatatataaattatgtatggtgaagtggagtgtattgtgtaggtcccgtatttaatgcctctgactgcctttgaagcgcagccctctgtggcccgcagccccctgagcctggctgttgtgtggtatttatgctctctttgtctgcctgtttctaaggaaatgcatgtgtgccctgagccgtgatgatcctcccatccgtgttgtgagcacaggcatttgtgtctggtctgtcctccctgttgattggtctggcatttccggtattaaaatgataaaataaatggcat

SEQ ID NO: 326217 - DNA, 1019 bp, Homo sapiens
  misc_feature (1011)..(1011): n is a, c, g, or t
gccttcgcgtcccttccttcccggagctggcaggcgggccgcggcggcggcgggcagcggacgggcggactgacgggcgcctccaccttgctccctccctggctgccggcttccttttgtctttctgggcggcgatgagcgcagggccggcgcagcagctgcgggcgcacggaggcccgcgctgctagtcactcctcccggcctcggcgcgcttgtcccgggcagcggcccgggcccgctgcagccgccgccggcgccgaacttgggctcgggaagccggcggaccgcgtcctgcgccggagcaggggcatggtctagtggcccagtcaggacgcggaaacactccctggaggttctgacccgctccctctcagcctccgcctggtctctgggttggctgttccagctccaaagagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgccatgggcaaacagaacagcaagctgcggcccgaggtgctgcaggacctgcgggagaacacggagttcaccgaccacgagctgcaggagtggtacaagggcttcctcaaggactgccccaccggccacctgaccgtggacgagttcaagaagatctacgccaacttcttcccctacggcgacgcttccaagttcgccgagcacgtcttccgcaccttcgacaccaacggcgacggcaccatcgacttccgggagttcatcattgcgctgagcgtgacctcgcggggcaagctggagcagaagctcaagtgggccttcagcatgtacgacctggacggcaacggctacatcagccgcagcgagatgctggagatcgtgcagccatctacaaatggtgtctctgtgatgagatgccgagatgagtcncccggaga

SEQ ID NO: 326218 - DNA, 250 bp, Homo sapiens
ggattctaagctgactgactttcatgttccctgagcttgtgaccactgcaacacttgacatcactctaagcccaggcttgctgcaggtctctcaagagctctgaagtttatgtggctttctatccttcatggactgggggaagacccaaggagggtactgaggctatttgggaatactggccagggacctgggtccagaagtctgtcctggtggccccgacaggtatgcatcccagcaggtgtctgcaca

SEQ ID NO: 326219 - DNA, 156 bp, Homo sapiens
tcgggaaacactctttaagggtaaatataagatgatgtaatctcataatctttctaattataggataaaacaatctatggtaggtaattcaacatgtaaagaaaaagtactcttggacaggaactgtgaaaaatcattatgctattttcatgctta

SEQ ID NO: 326220 - DNA, 365 bp, Homo sapiens
catgagatactcattataggaaattcagataatatagactagtaaaagatatgaagaacagagtgaaaaatgtttgttaattcattagccactgttagtattttagatttggtctctcagattttttatataggtatttttttaaaaaaaataaaagctgatcatatgtttacatgtcttataacatgtctccttcacttaagaatataaaatggtcccctcttcaacgtatattattttcttttttctttttcttttctcataaaaaaaattaaaaacacataaaaaaaaaacccccttttggccctttttaaaaaacgccctttgaagacatcccccggagaagggggccccccgggaaaatc

SEQ ID NO: 326221 - DNA, 409 bp, Homo sapiens
catgagatactcattataggaaattcagataatatagactagtaaaagatatgaagaacagagtgaaaaatgtttgttaattcattagccactgttagtattttagatttggtctctcagattttttatataggtatttttttaaaaaaaataaaagctgatcatatgtttacatgtcttataacatgtctccttcacttaagaatataaaatggtcccctcttcaacgtatattattttcttttttctttttcttttctttttttttttttgagacggagtttcgctcttgttgcccaggctggagtgcagtggtacgatctcggcttactgcaacctctgcctcctgggttcaagtgattctcctgcctcagcctcctgagaagctgggattacaggcgcccaccac

SEQ ID NO: 326222 - DNA, 366 bp, Homo sapiens
cgtcagagattctgagttactcatcagctgccccaattttcttctcaaatataacattttcttcttacattaaaaagatttttttaaaaattttattattattgtactttaagttttagggtacatgtgcacaatgtgcaggtttgttacatatatatacatgtgccatgttggtgtgctgcaccattaactcgtcatttagcattaggtatatctcctaatgctatccctcccccctccccccaccccacaacagtctccgctgtgtgatgttccccttcctgtgtccatgtgttctcattgttcaattcccacctacgagttttaaatccactcctttcacattgagtttcttctctccctcct

SEQ ID NO: 326223 - DNA, 526 bp, Homo sapiens
ggagagaaaatattgatggaggggcggggagaaatgctcctttcccaggccctaagccctctgtgctgatccctgcctgctgcagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataaaaaaca

SEQ ID NO: 326224 - DNA, 1854 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataaaaaaca

SEQ ID NO: 326225 - DNA, 1996 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccggtgagctgatcctgccggggcctcaaacctggctcccagggctagcactggcctcaaaacaatcccagcagtcaccaccaatagtgacatcagccccatctgtttgacagcattaacatgaatcttgtgtcagcctcgtttttgacaatgttaacattaaaaaaaaaaaaaaaaaaaaagtgatgcggccgccggctcgctctcgcccaccgcggactccagggcgcgaaggcgggccgggtttttctcaatgcgcacttgcttcaggtttcctcttaacatcatcttactgagttcgcctcggacaccggatacaggcctagatttaaagacagtgtgtctatatatatgtatacgtctctacataaacgtatgccaacaaaatatcgacaatcaagagaccgctaggtaggcgagtcggcaacccggctccccggcaagagcgagcgccatggctgccgcggccgc

SEQ ID NO: 326226 - DNA, 1894 bp, Homo sapiens
  misc_feature (1883)..(1883): n is a, c, g, or t
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttaaggcttaaatctgagtgcacgtaaggaatgaagaaaccaacaccagaaccctaaactcaaatgatatggagcccatttagagcggcacccccacccctcagagacacgcanttccaccccat

SEQ ID NO: 326227 - DNA, 1785 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataaaaaaca

SEQ ID NO: 326228 - DNA, 727 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggcatgtcagccacgtggggtgggacccccagaatggatttgacgtgagtaacttcagagtctcttggactccactaaacttccacccaccctt

SEQ ID NO: 326229 - DNA, 368 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagactcacccaacaatcccaaggccctttttatacaaaaattctcagttctcttcactcaaggatttttaaagaaaaataaaagaattgtctttctgtctctctataaaaaaca

SEQ ID NO: 326230 - DNA, 776 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagtggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgagtaacttcagagtctcttggactccactaaacttccacccaccctt

SEQ ID NO: 326231 - DNA, 1784 bp, Homo sapiens
gctgctcattgcggaagttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaaggagcattgtggggctgtgtgcttcgtgaaggataacccccagaagtcctacttcatccgcctttacggccttcaggctggtcggctgctctgggaacaggagctgtactcacagcttgtctactccacccccacccccttcttccacaccttcgctggagatgactgccaagcggggctgaactttgcagacgaggacgaggcccaggccttccgggccctcgtgcaggagaagatacaaaaaaggaatcagaggcaaagtggagacagacgccagctacccccaccaccaacaccagccaatgaagagagaagaggagggctcccacccctgcccctgcatccaggtggagaccaaggaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagcatgtcagccacgtggggtgggacccccagaatggatttgacgtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccaggagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaagacccctggggccccagagagctcagcgctgcagccaccacctcagagctcagagggactggtgggggccctgatgcacgtgatgcagaagagaagcagagccatccactcctccgacgaaggggaggaccaggctggcgatgaagatgaagatgatgaatgggatgactgagtggctgagttacttgctgccctgtgctcctccccgcaggacatggctccccctccacctgctctgtgcccaccctccactctcctctactcacccaacaatcccaaggccctttttatacaaaaattctcagttctcttcactcaaggatttttaaagaaaaataaaagaattgtctttctgtctctctataaaaaaca

SEQ ID NO: 326232 - DNA, 751 bp, Homo sapiens
aaattccattccatgcgtagcaatatttctgtcgtttcatgtatggttctgtggtcatgatgtcaacatctttttcatccctaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaaggtgtgtctttctcaggatttgcatgtgttttgttgcaaatgatctctccagtggcttaccaacctgatgcctttccaacgctatttcgctatttcatcgctgggtcttatgataacaagtccactgttgtaggcttaatgtgcagagagtgtggcttgcgcaagtgctgtgtggcagctggttttccagtgctgcagctgattcctggttttcctttgccatgatacaatacgctttgcagccaggctgatgatgctatgtgagcttctttttttattttatttttttacccgccccccctcatctcaaatgtttgccagtcacattgctaatacatgtatatttttgtttttattttggggacagcaattcatatgcttttatttcaaatcgtacagttggattttggcacatagaggc

SEQ ID NO: 326233 - DNA, 9670 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcaccctaaaaaaaaaaaaatctctccaagcgttgg

SEQ ID NO: 326234 - DNA, 9959 bp, Homo sapiens
  misc_feature (9959)..(9959): n is a, c, g, or t
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcaccaaaaaaaaacaataaccagaactcagcgaacatacgaaccacaacaacacaagagggggggggcggccacaaaaaaaatctcgacgggggggcacccaaatccgcaagaacccactctcctcgaccaaagagtggcgcccaaaaaagggacataaatagaccggcggggagcgtgactacaaccagtcacgtgccggaaaccagcgacggaacattctgggaagaacctcctgtgggtcgacccgggcaacaatcagagctcactgagcaaaaataggcagtgcacagctgcgagaaatggagcaaagaatcgcgcccan

SEQ ID NO: 326235 - DNA, 9613 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatgggtaagtgaattgcaggtgggggaaggaaaggaaaaaaaagagagggaagaaaaaaaaagagaagaaaaaggatttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326236 - DNA, 9732 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326237 - DNA, 9595 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326238 - DNA, 9984 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326239 - DNA, 9239 bp, Homo sapiens
agagagaggagtgtgcagagcagagttatttagcattcaagggtggatctgcagaaaatcacacagcctcactgcgaagcatctgggcctggtggcaccgatggatgaggacagaaaatggggatcttttcagtgttttccttctaaaggttaggcatccggggctagaaagagtgagaaagacaaggattgatagaaaaggcagttccacgagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacagaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagttccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaacagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc

SEQ ID NO: 326240 - DNA, 5571 bp, Homo sapiens
accgctaaatcgtaagtgagggctgcatcctattgtcagtgaatgatggcggagctgagtggcttgtcatcattctcgaaaattctgagactagtgagctctctccctctctcccactcgccttattttcctgttcgccactgcggggacttctaatttgcagcttccctttccccggcacacacagacacgagctggtggcttgcagactgcgtctgtctggagctagagagccagagagccagcctgtggggataatgctcccgagaaggattctggcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagacgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacc
